United States Patent
Keller et al.

(10) Patent No.: US 9,833,498 B2
(45) Date of Patent: *Dec. 5, 2017

(54) METHODS OF TREATMENT OF COLLAGEN-MEDIATED DISEASES AND CONDITIONS

(75) Inventors: Gilbert Keller, Belmont, CA (US); Gregory I. Frost, Palm Beach, FL (US)

(73) Assignee: Halozyme, Inc., San Diego, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 12/381,063

(22) Filed: Mar. 6, 2009

(65) Prior Publication Data

US 2010/0003237 A1   Jan. 7, 2010

Related U.S. Application Data

(60) Provisional application No. 61/127,725, filed on May 14, 2008, provisional application No. 61/068,667, filed on Mar. 6, 2008.

(51) Int. Cl.
*A61K 38/48* (2006.01)
*C12N 9/64* (2006.01)

(52) U.S. Cl.
CPC ........ *A61K 38/4873* (2013.01); *A61K 38/482* (2013.01); *A61K 38/488* (2013.01); *A61K 38/4813* (2013.01); *C12N 9/6472* (2013.01); *C12N 9/6491* (2013.01); *C12Y 304/22015* (2013.01); *C12Y 304/24007* (2013.01)

(58) Field of Classification Search
CPC combination set(s) only.
See application file for complete search history.

(56) References Cited

U.S. PATENT DOCUMENTS

| | | | | |
|---|---|---|---|---|
| 3,536,809 A | 10/1970 | Applezweig | | 424/435 |
| 3,539,794 A | 11/1970 | Zaffaroni | | 362/34 |
| 3,598,123 A | 8/1971 | Zaffaroni | | 424/435 |
| 3,630,200 A | 12/1971 | Higuchi | | 424/427 |
| 3,710,795 A | 1/1973 | Higuchi et al. | | 424/424 |
| 3,845,770 A | 11/1974 | Theeuwes et al. | | 424/427 |
| 3,847,770 A | 11/1974 | Radlowe et al. | | 427/511 |
| 3,916,899 A | 11/1975 | Theeuwes et al. | | 424/424 |
| 4,002,531 A | 1/1977 | Royer | | 435/188 |
| 4,008,719 A | 2/1977 | Theeuwes et al. | | 424/427 |
| 4,044,126 A | 8/1977 | Cook et al. | | 514/180 |
| 4,179,337 A | 12/1979 | Davis et al. | | 435/181 |
| 4,202,314 A | 5/1980 | Smirnov et al. | | 60/138 |
| 4,214,584 A | 7/1980 | Smirnov et al. | | 604/135 |
| 4,288,433 A | 9/1981 | Koulbanis et al. | | 514/161 |
| 4,364,923 A | 12/1982 | Cook et al. | | 424/46 |
| 4,397,951 A | 8/1983 | Taki et al. | | 435/188 |
| 4,414,209 A | 11/1983 | Cook et al. | | 514/180 |
| 4,529,403 A | 7/1985 | Kamstra | | 604/136 |
| 4,645,668 A * | 2/1987 | Pinnell | | 424/94.2 |
| 4,687,610 A | 8/1987 | Vassilatos | | 264/211.14 |
| 4,769,027 A | 9/1988 | Baker et al. | | 424/493 |
| 4,952,496 A | 8/1990 | Studier et al. | | 435/91.41 |
| 4,983,164 A | 1/1991 | Hook et al. | | 604/87 |
| 5,033,252 A | 7/1991 | Carter | | 53/425 |
| 5,051,449 A | 9/1991 | Kligman | | 514/559 |
| 5,052,558 A | 10/1991 | Carter | | 206/439 |
| 5,059,595 A | 10/1991 | Le Grazie | | 424/468 |
| 5,073,543 A | 12/1991 | Marshall et al. | | 514/21 |
| 5,120,548 A | 6/1992 | McClelland et al. | | 424/473 |
| 5,122,614 A | 6/1992 | Zalipsky | | 548/520 |
| 5,171,081 A | 12/1992 | Pita et al. | | 362/34 |
| 5,183,550 A | 2/1993 | Mattiessen | | 204/415 |
| 5,323,907 A | 6/1994 | Kalvelage | | 206/531 |
| 5,324,844 A | 6/1994 | Zalipsky | | 548/520 |
| 5,342,756 A | 8/1994 | Risteli et al. | | |
| 5,354,566 A | 10/1994 | Addesso et al. | | 426/9 |
| 5,395,326 A | 3/1995 | Haber et al. | | 604/90 |
| 5,446,090 A | 8/1995 | Harris | | 525/54.1 |
| 5,523,090 A | 6/1996 | Znaiden et al. | | 424/401 |
| 5,536,499 A | 7/1996 | Znaiden et al. | | 424/401 |
| 5,538,853 A | 7/1996 | Risteli et al. | | 435/7.9 |
| 5,589,171 A | 12/1996 | Wegman | | 424/94.67 |
| 5,591,767 A | 1/1997 | Mohr et al. | | 514/413 |
| 5,612,460 A | 3/1997 | Zalipsky | | 530/391.9 |
| 5,639,476 A | 6/1997 | Oshlack et al. | | 424/468 |
| 5,643,575 A | 7/1997 | Martinez et al. | | 424/194.1 |
| 5,667,793 A | 9/1997 | Cho et al. | | 424/401 |
| 5,672,662 A | 9/1997 | Harris et al. | | 525/408 |

(Continued)

FOREIGN PATENT DOCUMENTS

| | | |
|---|---|---|
| EP | 0576953 | 1/1994 |
| EP | 0822199 | 9/2004 |
| EP | 01064951 | 8/2007 |
| GB | 2 323 530 | 9/1998 |
| JP | 6-192124 | 7/1994 |
| JP | 7-075573 | 3/1995 |
| JP | 2001-523943 A | 11/2001 |
| MX | 331943 | 7/2015 |
| WO | WO 94/28024 | 12/1994 |
| WO | WO 95/07687 | 3/1995 |

(Continued)

OTHER PUBLICATIONS

Nakamura et al, Effects of rat fetuin on stimulation of bone resorption in the presence of parathyroid hormone. Biosci Biotechnol Biochem. Aug. 1999;63(8):1383-91.*

Beltran et al, Comparative action of cathepsins B and L on intramuscular collagen as assessed by differential scanning calorimetry. Meat Sci. 1992;32(3): p. 299 Abstract only.*

(Continued)

*Primary Examiner* — Sheridan Swope
(74) *Attorney, Agent, or Firm* — Dentons US LLP; Stephanie Seidman

(57) ABSTRACT

Methods and combinations are provided for controlling the duration of action, in vivo, of matrix-degrading enzymes. The methods and combinations permit temporary in-vivo activation of matrix-degrading enzymes upon administration to the extra cellular matrix (or "ECM"). Matrix-degrading enzymes having a controlled duration of action can be used to treat ECM-mediated diseases or disorders characterized by increased deposition or accumulation of one or more ECM components.

23 Claims, 11 Drawing Sheets

(56) References Cited

U.S. PATENT DOCUMENTS

| | | | |
|---|---|---|---|
| 5,674,533 A | 10/1997 | Santus et al. | 424/493 |
| 5,705,170 A | 1/1998 | Kong et al. | 424/401 |
| 5,705,364 A | 1/1998 | Etcheverry et al. | 435/70.3 |
| 5,733,566 A | 3/1998 | Lewis | 424/426 |
| 5,747,027 A | 5/1998 | Stern et al. | 424/94.62 |
| 5,747,322 A | 5/1998 | Crail et al. | 435/226 |
| 5,766,581 A | 6/1998 | Bartley et al. | 424/85.1 |
| 5,788,670 A | 8/1998 | Reinhard et al. | 604/89 |
| 5,795,569 A | 8/1998 | Bartley et al. | 424/85.1 |
| 5,808,096 A | 9/1998 | Zalipsky | 548/520 |
| 5,827,721 A | 10/1998 | Stern et al. | 435/201 |
| 5,830,741 A | 11/1998 | Dwulet et al. | 435/220 |
| 5,900,461 A | 5/1999 | Harris | 525/54.11 |
| 5,919,455 A | 7/1999 | Greenwald et al. | 424/178.1 |
| 5,932,462 A | 8/1999 | Harris et al. | 435/188 |
| 5,962,482 A | 10/1999 | Bissett | 514/356 |
| 5,971,953 A | 10/1999 | Bachynsky | 604/90 |
| 5,976,556 A | 11/1999 | Norton et al. | 424/401 |
| 5,985,263 A | 11/1999 | Lee et al. | 424/85.2 |
| 5,990,237 A | 11/1999 | Bentley et al. | 525/54.2 |
| 6,022,539 A | 2/2000 | Wegman | 424/94.67 |
| 6,054,569 A | 4/2000 | Bennett et al. | 536/23.2 |
| 6,060,474 A | 5/2000 | Williams et al. | 514/253.08 |
| 6,071,526 A | 6/2000 | Schmidt et al. | 424/401 |
| 6,086,872 A | 7/2000 | Wegman | 424/94.67 |
| 6,113,906 A | 9/2000 | Greenwald et al. | 424/194.1 |
| 6,153,207 A | 11/2000 | Pugliese | 424/402 |
| 6,214,966 B1 | 4/2001 | Harris | 528/322 |
| 6,258,351 B1 | 7/2001 | Harris | 424/78.3 |
| 6,274,364 B1 | 8/2001 | Bernard et al. | 435/212 |
| 6,294,350 B1 | 9/2001 | Peterson | 435/29 |
| 6,340,742 B1 | 1/2002 | Burg et al. | 530/351 |
| 6,353,028 B2 | 3/2002 | Easterling | 514/654 |
| 6,399,348 B1 | 6/2002 | Will et al. | 435/219 |
| 6,413,507 B1 | 7/2002 | Bentley et al. | 424/78.02 |
| 6,420,339 B1 | 7/2002 | Gegg et al. | 514/12 |
| 6,437,025 B1 | 8/2002 | Harris et al. | 523/406 |
| 6,443,914 B1 | 9/2002 | Costantino | 601/2 |
| 6,448,369 B1 | 9/2002 | Bentley et al. | 528/425 |
| 6,451,575 B1 | 9/2002 | Arner et al. | 435/226 |
| 6,461,802 B1 | 10/2002 | Van Thillo et al. | 430/336 |
| 6,470,216 B1 | 10/2002 | Knowlton | 607/101 |
| 6,495,659 B2 | 12/2002 | Bentley et al. | 528/425 |
| 6,566,331 B1 | 5/2003 | Lezdey et al. | 514/12 |
| 6,569,431 B1 | 5/2003 | Bishop et al. | 424/401 |
| 6,620,592 B2 | 9/2003 | Kapeller-Libermann | 506/39 |
| 6,656,701 B2 | 12/2003 | Bishop et al. | 435/23 |
| 6,676,977 B2 | 1/2004 | Murad | 424/728 |
| 6,682,904 B1 | 1/2004 | Frost | 435/18 |
| 6,692,468 B1 | 2/2004 | Waldenburg | 604/191 |
| 6,737,055 B2 | 5/2004 | Bernard et al. | 424/94.64 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 6,953,583 B1 | 10/2005 | Ghisalberti | 424/401 |
| 6,972,005 B2 | 12/2005 | Boehum et al. | 604/191 |
| 7,261,889 B2 | 8/2007 | Weber et al. | 424/94.62 |
| RE39,941 E | 12/2007 | Wegman | 424/94.67 |
| 7,544,499 B2 | 6/2009 | Frost et al. | 435/200 |
| 2001/0021763 A1 | 9/2001 | Harris | |
| 2001/0044526 A1 | 11/2001 | Shen | 530/409 |
| 2001/0046481 A1 | 11/2001 | Bentley et al. | 424/78.18 |
| 2002/0009774 A1 | 1/2002 | Kapeller-Libermann | 435/69.1 |
| 2002/0052430 A1 | 5/2002 | Harris et al. | 523/406 |
| 2002/0072573 A1 | 6/2002 | Bentley et al. | 525/409 |
| 2002/0106388 A1 | 8/2002 | Pugliese | 424/401 |
| 2002/0156047 A1 | 10/2002 | Zhao | 514/58 |
| 2003/0012778 A1 | 1/2003 | Zimmerman et al. | 424/94.64 |
| 2003/0026794 A1* | 2/2003 | Fein | 424/94.2 |
| 2003/0045495 A1 | 3/2003 | Li et al. | 514/44 R |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 525/54.11 |
| 2003/0170243 A1 | 9/2003 | Stern et al. | 424/146.1 |
| 2003/0220447 A1 | 11/2003 | Harris | 525/54.1 |
| 2004/0013637 A1 | 1/2004 | Bentley et al. | 424/78.17 |
| 2004/0096921 A1 | 5/2004 | Stern et al. | 435/7.92 |
| 2004/0235734 A1 | 11/2004 | Bossard et al. | 514/12 |
| 2004/0268425 A1 | 12/2004 | Bookbinder et al. | 800/18 |
| 2005/0042213 A1 | 2/2005 | Gelder et al. | 424/94.64 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.61 |
| 2005/0287134 A1 | 12/2005 | Klein | 424/94.61 |
| 2006/0104968 A1 | 5/2006 | Bookbinder et al. | 424/94.61 |
| 2007/0003541 A1 | 1/2007 | Faudoa et al. | 424/94.65 |
| 2007/0004036 A1 | 1/2007 | Faudoa et al. | 435/325 |
| 2007/0128685 A1 | 6/2007 | Faudoa et al. | 435/34 |
| 2007/0134228 A1 | 6/2007 | Stern et al. | 424/94.61 |
| 2007/0148156 A1 | 6/2007 | Frost et al. | 424/94.61 |
| 2007/0224183 A1 | 9/2007 | Sabatino et al. | 424/94.63 |
| 2007/0224184 A1 | 9/2007 | Badalemente et al. | 424/94.63 |
| 2008/0131500 A1 | 6/2008 | Chang | 424/451 |
| 2009/0010918 A1 | 1/2009 | Badalemente et al. | 424/94.67 |
| 2009/0123367 A1 | 5/2009 | Bookbinder et al. | 424/1.49 |
| 2009/0181013 A1 | 7/2009 | Bookbinder et al. | 424/130.1 |
| 2009/0181032 A1 | 7/2009 | Bookbinder et al. | 424/141.1 |
| 2009/0214505 A1 | 8/2009 | Bookbinder et al. | 424/94.1 |
| 2009/0253175 A1 | 10/2009 | Bookbinder et al. | 435/69.1 |
| 2010/0003238 A1 | 1/2010 | Frost et al. | 424/94.62 |
| 2010/0143457 A1 | 6/2010 | Wei et al. | |
| 2010/0184845 A1 | 7/2010 | Frost et al. | 514/44 R |
| 2010/0196423 A1 | 8/2010 | Bookbinder et al. | 424/247.1 |
| 2010/0211015 A1 | 8/2010 | Bookbinder et al. | 604/187 |
| 2010/0260739 A1 | 10/2010 | Short et al. | 424/94.5 |
| 2010/0284995 A1 | 11/2010 | Bookbinder et al. | |
| 2011/0008309 A1 | 1/2011 | Bookbinder et al. | |
| 2011/0053247 A1 | 3/2011 | Baker et al. | |
| 2011/0152359 A1 | 6/2011 | Bookbinder et al. | 435/200 |
| 2012/0108455 A1 | 5/2012 | Kodandapani et al. | 506/9 |
| 2012/0148555 A1 | 6/2012 | Bookbinder et al. | |
| 2012/0251620 A1 | 10/2012 | Bookbinder et al. | |
| 2014/0271609 A1 | 9/2014 | Keller et al. | 424/94.62 |

FOREIGN PATENT DOCUMENTS

| | | |
|---|---|---|
| WO | WO 94/15848 | 3/1996 |
| WO | WO 96/13523 | 5/1996 |
| WO | WO 97/42308 | 11/1997 |
| WO | WO 98/13484 | 4/1998 |
| WO | WO 00/02017 | 1/2000 |
| WO | WO 00/66139 | 11/2000 |
| WO | WO 01/87925 | 4/2001 |
| WO | WO 01/76640 | 10/2001 |
| WO | WO 02/49673 | 6/2002 |
| WO | WO 02/080962 | 10/2002 |
| WO | WO 2004/058147 | 7/2004 |
| WO | WO 01/47584 | 9/2004 |
| WO | WO 2004/078140 | 9/2004 |
| WO | WO2004/078140 | 9/2004 |
| WO | WO 2005/000360 | 1/2005 |
| WO | WO 2006/091870 | 8/2006 |
| WO | WO 2006/091871 | 8/2006 |
| WO | WO2006/091871 | 8/2006 |
| WO | WO 2007/006030 | 1/2007 |
| WO | WO 2009/111083 | 9/2009 |
| WO | WO 2009/128917 | 10/2009 |
| WO | WO 2010/102262 | 9/2010 |
| WO | WO 2010/104821 | 9/2010 |

OTHER PUBLICATIONS

Kruglikov, The Pathophysiology of Cellulite: Can the Puzzle Eventually Be Solved? Journal of Cosmetics, Dermatological Sciences and Applications, 2012, 2, 1-7.*

Hexsel et al, Subcision: a treatment for cellulite. Int J Dermatol. Jul. 2000;39(7):539-44.*

Turk et al, Acidic pH as a physiological regulator of human cathepsin L activity. Eur J Biochem. Feb. 1999;259(3):926-32.*

PIR_80:* database Acc#KHHUL from Mason et al, Biochem J. Dec. 1, 1986;240(2):373-7. Alignment with SEQ ID No. 1.*

(56) References Cited

OTHER PUBLICATIONS

Mason et al, The N-terminal amino acid sequences of the heavy and light chains of human cathepsin L. Biochem J. Dec. 1, 1986;240(2):373-7.*
Berasain et al, Proteinases secreted by Fasciola hepatica degrade extracelullar matrix and basement membrane components. J Parasitol. Feb. 1997;83(1):1-5.*
Zlotogorski, Distribution of skin surface pH on the forehead and cheek of adults. Arch Dermaol Res (1987) 279:398-401.*
Ando et al., "Effects of chondroitinase ABC on degenerative intervertebral discs," Clin Orthop 318:214-221 (1995).
Austin, R. and J. Zuk, "Epidural adhesions after chymopapain chemonucleolysis," J R Coll Surg Edinb 34(1):30-32 (1989).
Bitz, D. and L. Ford, "An evaluation of narrowing following intradiskal injection of chymopapain," Orthop 129:191-195 (1977).
Brandhorst et al., "Successful human islet isolation utilizing recombinant collagenase" Diabetes 52(5):1143-1146 (2003).
Chiba et al., "Matrix replenishment by intervertebral disc cells after chemonucleolysis in vitro with chondroitinase ABC and chymopapain," Spine J. 7(6):694-700 (2007).
Dando et al., "Quantitative assessment of human proteinases as agents for chemonucleolysis," Spine (Phila Pa 1976). 13(2):188-192 (1988).
Eurrell et al., "The effects of chondroitinase ABC on the rabbit intervertebral disc. A roentgenographic and histologic study," Clin Orthop Relat Res. 256:238-243 (1990).
Fry et al., "Radiographic and histologic effects of chondroitinase ABC on normal canine lumbar intervertebral disc," Spine (Phila Pa 1976). 16:816-819 (1991).
Henderson et al., "Nucleolysis of the rabbit intervertebral disc using chondroitinase ABC," Spine (Phila Pa 1976). 16:203-208 (1991).
Imai et al., "Restoration of disc height loss by recombinant human osteogenic protein-1 injection into intervertebral discs undergoing degeneration induced by an intradiscal injection of chondroitinase ABC," Spine (Phila Pa 1976). 32(11):1197-1205 (2007).
Kato et al., "Serial changes observed by magnetic resonance imaging in the intervertebral disc after chemonucleolysis. A consideration of the mechanism of chemonucleolysis," Spine (Phila Pa 1976). 17(8):934-939 (1992).
Kubo et al., "A comparative study of chemonucleolysis with recombinant human cathepsin L and chymopapain. A radiologic, histologic, and immunohistochemical assessment," Spine (Phila Pa 1976). 24(2):120-127 (1999).
Lu et al., "Effects of chondroitinase ABC and chymopapain on spinal motion segment biomechanics. An in vivo biomechanical, radiologic, and histologic canine study," Spine (Phila Pa 1976). 22(16):1828-1834 (1997).
Melrose et al., "Intervertebral disc reconstitution after chemonucleolysis with chymopapain is dependent on dosage," Spine (Phila Pa 1976). 21:9-17 (1996).
Nahir et al., "Chondroitinase ABC affects the activity of intracellular enzymes in rabbit articular cartilage chondrocytes," J Rheumatol 22(4):702-707 (1995).
Olmarker et al., "Effects of intrathecal application of collagenase in the lumbar spine: an experimental study in rabbits," Spine (Phila Pa 1976). 12:477-482 (1987).
Olmarker et al., "Chondroitinase ABC (pharmaceutical grade) for chemonucleolysis. Functional and structural evaluation after local application on intraspinal nerve structures and blood vessels," Spine (Phila Pa 1976). 21(17):1952-1956 (1996).
Sugimura et al., "Experimental chemonucleolysis with chondroitinase ABC in monkeys," Spine (Phila Pa 1976). 21(2):161-165 (1996).
Takahashi et al., "Chemonucleolytic effects of chondroitinase ABC on normal rabbit intervertebral discs. Course of action up to 10 days postinjection and minimum effective dose," Spine (Phila Pa 1976). 21:2405-2411 (1996).
Wakita et al., "Chemonucleolysis with calpain I in rabbits," Spine (Phila Pa 1976). 18(1):159-164 (1993).

Whitham et al., "Comparison of human stromelysin and collagenase by cloning and sequence analysis," Biochem. J. 240:913-916 (1986).
Yamada et al., "Investigation of the short-term effect of chemonucleolysis with chondroitinase ABC," J Vet Med Sci 63(5):521-525 (2001).
News Release, Halozyme Therapeutics Inc., "Halozyme Therapeutics, Inc. Announces Research Alliance with BioAtla, LLC for Conditionally Active Biologics" Jan. 19, 2010, retrieved from: http://in.reuters.com/money/quotes/keyDevelopments?symbol=HALO.O, [retrieved on Apr. 27, 2010] [2 pages].
International Preliminary Report on Patentability, issued Jul. 9, 2010, in connection with corresponding International Patent Application No. PCT/US2009/001486. 10 pages.
International Search Report and Written Opinion, issued Jun. 7, 2010, in connection with related International Patent Application No. PCT/US2010/026444. 16 pages.
U.S. Appl. No. 12/802,864, filed Jun. 15, 2010.
U.S. Appl. No. 12/735,868, filed Aug. 20, 2010.
Adams et al., "The c-myc oncogene driven by immunoglobulin enhancers induces lymphoid malignancy in transgenic mice," Nature 318:533-538 (1985).
Albert et al., "Cell junctions, cell adhesions and the extracellular matrix," Molecular Biology of the Cell. New York: Garland Publishers, 972-978 (1994).
Alexander et al., "Expression of the c-myc oncogene under control of an immunoglobulin enhancer in E mu-myc transgenic mice," Mol. Cell Biol. 7:1436-1444 (1987).
Ansel, Introduction to Pharmaceutical Dosage Forms, Fourth Edition, 126 (1985).
Atley et al., "Proteolysis of human bone collagen by cathepsin K: characterization of the cleavage sites generating by cross-linked N-telopeptide neoepitope," Bone 26:241-247 (2000).
Atschul, S., "Basic local alignment search tool," J Molec Biol 215(3):403-410 (1990).
Baici et al., "A handy assay for collagenase using reconstituted fluorescein-labeled collagen fibrils," Anal. Biochem. 108:230-232 (1980).
Barrett, A. and H. Kirschke, "Cathepsin B, Cathepsin H, and cathepsin L," Methods Enzymol. 80:535-561 (1981).
Barrett et al., "Evolutionary families of metallopeptidases," Meth. Enzymol. 248:183-228 (1994).
Barrett et al., "Families of aspartic peptidases, and those of unknown catalytic mechanism," Meth. Enzymol. 248:105-120 (1994).
Barrett et al., "Families of cysteine peptidases," Meth. Enzymol 244:461-486 (1994).
Barrett et al., "Families of serine peptidases," Meth. Enzymol. 244:18-61 (1994).
Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).
Benjamin et al., "Increasing the thermal stability of euphauserase. A cold-active and multifunctional serine protease from Antarctic krill," Eur. J. Biochem. 268 :127-131 (2001).
Bernoist, C. and P. Chambon, "In vivo sequence requirements of the SV40 early promotor region," Nature 290:304-310 (1981).
Bohley et al., "Intracellular Protein Turnover." in S. Holzer and H. Tschcsche (eds.). Biological Functions of Proteinases, pp. 17-34, Springer-Verlag: Berlin (1979).
Brinster et al., "Regulation of metallothionein—thymidine kinase fusion plasmids injected into mouse eggs," Nature 296:39-42 (1982).
Bromme et al., "Functional expression of human cathepsin S in Saccharomyces cerevisiae. Purification and characterization of the recombinant enzyme," J Biol. Chem. 268:4832-4838 (1993).
Brumeanu et al., "Derivatization with monomethoxypolyethylene glycol of Igs expressing viral epitopes obviates adjuvant requirements," J Immunol. 154:3088-3095 (1995).

(56) References Cited

OTHER PUBLICATIONS

Buck et al., "Degradation of extracellular-matrix proteins by human cathepsin B from normal and tumour tissues," Biochem J. 282:273-278 (1992).
Buhling et al., "Lysosomal cysteine proteases in the lung: role in protein processing and immunoregulation," Eur. Respir. J. 23:620-628 (2004).
Burjanadze, T., "Hydroxyproline content and location in relation to collagen thermal stability," Biopolymers 18:(4)931-938 (2002).
Caliceti, P. and F. Veronese, "Pharmacokinetic and biodistribution properties of poly(ethylene glycol)-protein conjugates," Adv. Drug Deliv. Rev. 55(10):1261-1277 (2003).
Carmona et al., "Potency and selectivity of the cathepsin-L propeptide as an inhibitor of cysteine proteases," Biochemistry 35:8149-8157 (1996).
Carrillo et al., "The multiple-sequence alignment problem in biology," SIAM J Applied Math 481:1073-1082 (1988).
Chapman et al., "Therapeutic antibody fragments with prolonged in vivo half-lives," Nature Biotech. 17:780-783 (1999).
Chapman, R. and F. Spinale, "Extracellular protease activation and unraveling of the myocardial interstitium: critical steps toward clinical applications," Am J. Physiol Heart Circ. Physiol. 286:1-10 (2004).
Cheng et al., "PEGylated adenoviruses for gene delivery to the intestinal epithelium by the oral route," Pharm. Res. 20(9):1444-1451 (2003).
Clark, I and G. Murphy. "Matrix Proteinases," in Dynamics of Bone and Cartilage Metabolism, Academic Press, pp. 181-198 (2006).
Coulombe et al., "Structure of human procathepsin L reveals the molecular basis of inhibition by the prosegment," EMBO J. 15:5492-5503 (1996).
Danilkovitch-Miagkova, et al., "Hyaluronidase 2 negatively regulates RON receptor tyrosine kinase and mediates transformation of epithelial cells by jaagsiekte sheep retrovirus," Proc Natl Acad Sci USA. 100(8):4580-4585 (2003).
Davila et al., "Gene transfer of inducible nitric oxide synthase complementary DNA regresses the fibrotic plaque in an animal model of Peyronie's disease," Biol. Reprod. 71:1568-1577 (2004).
Deboer et al., "The tac promoter: a functional hybrid derived from the trp and lac promoters," Proc. Natl. Acad. Sci. USA 80:21-25 (1983).
Dehrmann et al., "Mature cathepsin L is substantially active in the ionic milieu of the extracellular medium," Arch. Biochem. Biophys. 324:93-98 (1995).
Devereux et al, "A comprehensive set of sequence analysis programs for the VAX," Nucleic Acids Research 12:387 (1984).
Eastell, R., Bone Markers: Biochemical and Clinical Perspectives, Chapman & Hall/CRCPress/Kluwer, p. 40 (2001).
Edwards, C. and W. O'Brien, "Modified assay for determination of hydroxyproline in a tissue hydrolyzate," Clin. Chim. Acta 104:161-167 (1980).
Ernst et al., "Enzymatic degradation of glycosaminoglycans," Critical Reviews in Biochemistry and Molecular Biology 30(5):387-444 (1995).
Felix et al., "Pegylated peptides. IV. Enhanced biological activity of site-directed pegylated GRF analogs," Int. J. Peptide Res. 46:253-264 (1995).
Frost et al., "Purification, cloning, and expression of human plasma hyaluronidase," Biochem Biophys Res Commun. 236(1):10-15 (1997).
Frost, G., "Recombinant human hyaluronidase (rHuPH20): an enabling platform for subcutaneous drug and fluid administration," Expert Opin. Drug. Deliv. 4:427-440 (2007).
Gardner et al., "The complete nucleotide sequence of an infectious clone of cauliflower mosaic virus by M13mp7 shotgun sequencing," Nucleic Acids Res. 9:2871-2888 (1981).
Garnero et al., "The collagenolytic activity of cathepsin K is unique among mammalian proteinases," J. Biol. Chem 273:32347-32352 (1998).

GenBank: EAW62736.1. cathepsin L, isoform CRA_a [*Homo sapiens*], Version 119583140 [accessed on May 6, 2009] [4 pages].
Gilat et al., "Molecular behavior adapts to context: heparanase functions as an extracellular matrix-degrading enzyme or as a T cell adhesion molecule, depending on the local pH.," J Exp. Med., 181:1929-1934 (1995).
Gilbert, W. and L. Villa-Komaroff, "Useful Proteins from Recombinant Bacteria," Scientific American 242:79-94 (1980).
Goldshmidt et al., "Heparanase mediates cell adhesion independent of its enzymatic activity," The FASEB J. 17:1015-1025 (2003).
Green, G. and K. Reagan, "Determination of hydroxyproline by high pressure liquid chromatography," Anal. Biochem. 201:265-269 (1992).
Gribskov, M. and R. Burgess, "Sigma factors from *E. coli, B. subtilis*, phage SPO1, and phage T4 are homologous proteins," Nucl. Acids Res. 14:6745-6763 (1986).
Grosschedl et al., "Introduction of a mu immunoglobulin gene into the mouse germ line: specific expression in lymphoid cells and synthesis of functional antibody," Cell 38:647-658 (1984).
Halozyme Therapeutics Investor Presentation, "Company Overview," May 15, 2008. (15 pages).
Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature (3)15:115-122 (1985).
Harada, H. and M. Takahashi, "CD44-dependent intracellular and extracellular catabolism of hyaluronic acid by hyaluronidase-1 and -2," J. Biol. Chem. 8:5597-5607 (2006).
Harris et al. "Definition and redesign of the extended substrate specificity of granzyme," J Biol Chem 273(42):27364-27373 (1998).
Harris et al., "Chemistry for peptide and protein PEGylation," Adv. Drug Deliv. Rev. 54:459-476 (2002).
Harris, J., "The effect of pegylation on pharmaceuticals," Nature Reviews 2:215 et seq. (2003).
Hartmann et al., "Radioimmunoassay of type I collagen that mainly detects degradation products in serum: application to patients with liver diseases," Clin. Chem. 36:421-426 (1990).
Hata et al., "Assay of serum pyridinoline: a potential marker for bone resorption," Clin.Chimica. Acta. 235:221-227 (1995).
Hedstrom, L., "Serine protease mechanism and specificity," Chem Rev 102:4501-4523 (2002).
Herrera-Estrella et al., "Exp[ression of chimaeric genes transferred into plant cells using a ti-plasmid-derived vector,"Nature 303:209-213 (1984).
Herrera-Estrella et al., "Light-inducible and chloroplast-associated expression of a chimaeric gene introduced into Nicotiana tabacum using a Ti plasmid vector," Nature 310(5973):115-120 (1984).
Hibi et al., "Chondroitinase C activity of Streptococcus intermedius," FEMS-Microbiol-Lett. 48(2):121-124 (1989).
Hollander et al., "Increased damage to type II collagen in osteoarthritic articular cartilage detected by a new immunoassay," J. Clin. Invest. 93:1722-1732 (1994).
Hosfield et al., "Crystal structure of calpain reveals the structural basis for Ca(2+)-dependent protease activity and a novel mode of enzyme activation," EMBO J. 18:6880-6889 (1999).
Hovingh, P. and A. Linker, "Hyaluronidase activity in leeches (Hirudinea)," Comp Biochem Physiol B Biochem Mol Biol. 124(3):319-326 (1999).
Hulett et al., "Identification of active-site residues of the prometastatic endoglycosidase heparanase," Biochemistry, 39:15659-15667 (2000).
Inlander, C., Skin : head-to-toe tips for health and beauty, New York:Walker, pp. 1-7 (1998).
Iozzo, R., Proteoglycans: Structure, biology, and Molecular Interactions, CRC Press, pp. 94-96 (2000).

(56) References Cited

OTHER PUBLICATIONS

Ito et al., "An enzymatic estimation of free hydroxyproline in tissue hydrolysates," Anal. Biochem. 151:510-514 (1985).
IUPAC, "IUPAC-IUB Commission on Biochemical Nomenclature. A one-letter notation for amino acid sequences. Tentative rules," J. Biol. Chem. 243:3557-3559 (1968).
IUPAC-IUB, "Abbreviated nomenclature of synthetic poypeptides-polymerized amino acids-revised recommendations," Commission on Biochemical Nomenclature, Biochemistry 11:1726-1731 (1972).
Jackson et al., "Glycosaminoglycans: molecular properties, protein interactions, and role in physiological processes," Physiol. Rev. 71:481-539 (1991).
Jay et al., "Construction of a general vector for efficient expression of mammalian proteins in bacteria: use of a synthetic ribosome binding site," Proc. Natl. Acad. Sci. USA 78:5543-5548 (1981).
Jerala et al., "pH-induced conformational transitions of the propeptide of human cathepsin L. A role for a molten globule state in zymogen activation," J Biol. Chem., 273:11498-11504 (1998).
Kelsey et al., "Species- and tissue-specific expression of human alpha 1-antitrypsin in transgenic mice," Genes and Devel. 1:161-171 (1987).
Khan et al., "Structural aspects of activation pathways of aspartic protease zymogens and viral 3C protease precursors," Proc. Natl. Acad. Sci. USA, 96:10968-10975 (1999).
Khan, A. and M. James, "Molecular mechanisms for the conversion of zymogens to active proteolytic enzymes," Protein Science 7:815-836 (1998).
King, M., "Medical biochemistry page," found at: www.indstate.edu/thcme/mwking/extracellularmatrix.html redirected to http://themedicalbiochemistrypage.org/ [accessed on Apr. 28, 2009] [4 pages].
Kjellen, L., and U. Lindahl, "Proteoglycans: structures and interactions," Annu. Rev. Biochem. 60:443-475 (1991).
Koklitis et al., "Purification of recombinant human prostromelysin. Studies on heat activation to give high-Mr and low-Mr active forms, and a comparison of recombinant with natural stromelysin activities," Biochem J., 276:217-221 (1991).
Kollias et al., "Regulated expression of human A gamma-, beta-, and hybrid gamma beta-globin genes in transgenic mice: manipulation of the developmental expression patterns," Cell 46:89-94 (1986).
Krumlauf et al., Developmental regulation of alpha-fetoprotein genes in transgenic mice, Mol. Cell. Biol. 5:1639-1648 (1985).
Kummer et al., "Expression of human recombinant granzyme A zymogen and its activation by the cysteine proteinase cathepsin C," J Biol. Chem. 271:9281-9286 (1996).
Lalancette et al, "Characterization of an 80-kilodalton bull sperm protein identified as PH-20," Biol Reprod. 65(2):628-636 (2001).
Leder et al., "Consequences of widespread deregulation of the c-myc gene in transgenic mice: multiple neoplasms and normal development," Cell 45:485-495 (1986).
Lindstrom et al., "'Collagenous colitis' with watery diarrhoea—a new entity?" Pathol. Eur. 11:87-89 (1976).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides. II. Solid-phase synthesis of amino-, carboxy- and side-chain-pegylated peptides," Int. J. Peptide Protein Res. 43:127-138 (1994).
Luck, J., "Dupuytren's contracture; a new concept of the pathogenesis correlated with surgical management," J. Bone Joint Surg., 41A:635-664 (1959).
Lutgens et al., "Cathepsin cysteine proteases in cardiovascular disease," The FASEB J. 21:3029-3041 (2007).
Macdonald, R., "Expression of the pancreatic elastase I gene in transgenic mice," Hepatology 7:42S-51S (1987).
Magram et al., "Developmental regulation of a cloned adult beta-globin gene in transgenic mice," Nature 315(6017):338-340 (1985).
Manzetti et al., "Modeling of enzyme-substrate complexes for the metalloproteases MMP-3, ADAM-9 and ADAM-10," J of Computer-Aided Mol. Design 17:551-565 (2003).

Mason et al., "Human liver cathepsin L," Biochem. J. 226:233-241 (1985).
Mason et al., "The hypogonadal mouse: reproductive functions restored by gene therapy," Science 234:1372-1378 (1986).
McKenzie et al., "Biochemical characterization of the active heterodimer form of human heparanase (Hpa1) protein expressed in insect cells," Biochem. J., 373:423-435 (2003).
Mehvar et al., "Modulation of the pharmacokinetics and pharmacodynamics of proteins by polyethylene glycol conjugation," J. Pharm. Pharmaceut. Sci. 3(1):125-136 (2000).
Menard et al., "Autocatalytic processing of recombinant human procathepsin L. Contribution of both intermolecular and unimolecular events in the processing of procathepsin L in vitro," J. Biol. Chem. 273:4478-4484 (1998).
Meyer et al., "Biologically active monomeric and heterodimeric recombinant human calpain 1 produced using the baculovirus expression system," Biochem. J. 314:511-519 (1996).
Michelacci, Y. and C. Dietrich, "Chondroitinase C from Flavobacterium heparinum," J. Biol. Chem. 251:1154-1158 (1976).
Molinari, M. and E. Carafoli, "Calpain: a cytosolic proteinase active at the membranes," J Membr. Biol. 156(1):1-8 (1997).
Molineux, G., "Pegylation: engineering improved biopharmaceuticals for oncology," Pharmacotherapy 23 (8 Pt 2):3S-8S (2003).
Monfardini et al., Bioconjugate Chem. 6:62-69, 1995; Veronese et al., J. Bioactive Compatible Polymers 12:197-207, 1997;.
Murphy, G. and V. Knauper, "Relating matrix metalloproteinase structure to function: why the "hemopexin" domain?" Matrix Biol. 15:511-518 (1997).
Nagase et al., "Stepwise activation mechanisms of the precursor of matrix metalloproteinase 3 (stromelysin) by proteinases and (4-aminophenyl)mercuric acetate," Biochemistry, 29:5783-5789 (1990).
Needleman, S. and C. Wunsch, "A general method applicable to the search for similarities in the amino acid sequence of two proteins," A general method applicable to the search for similarities in the amino acid sequence of two proteins, J Mol Biol. 48:443-453 (1970).
Neuman, R. and M. Logan, "The determination of hydroxyproline," J Biol Chem 184:299-306 (1950).
News Release, Halozyme Therapeutics Inc., Q4 2008 Earnings Call Transcript found at: http://seekingalpha.com/article/125929-halozyme-therapeutics-inc-q4-2008-earnings-call-transcript [accessed on May 13, 2009] [12 pages].
Ohya, T., and Y. Kaneko, "Novel hyaluronidase from streptomyces," Biochim. Biophys. Acta 198:607-609 (1970).
Okada et al., "The precursor of a metalloendopeptidase from human rheumatoid synovial fibroblasts. Purification and mechanisms of activation by endopeptidases and 4-aminophenylmercuric acetate," Biochem J. 254:731-741 (1988).
Okada, Y., and I. Nakanashi, "Activation of matrix metalloproteinase 3 (stromelysin) and matrix metalloproteinase 2 ('gelatinase') by human neutrophil elastase and cathepsin G," FEBS Lett. 249:353-356 (1989).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Owen et al., "No association between the alpha-2 macroglobulin I1000V polymorphism and Alzheimer's disease," J. Leuk. Biol. 65:137-150 (1999).
Pearson, W. and D. Lipman "Improved tools for biological sequence comparison," Proc. Natl. Acad. Sci. USA 851:2444-2448 (1988).
Pham et al., "Large-scale transient transfection of serum-free suspension-growing HEK293 EBNAI cells: peptone additives improve cell growth and transfection efficiency," Biotechnology and Bioengineering 84:332-342 (2003).
Pinkert et al., "An albumin enhancer located 10 kb upstream functions along with its promoter to direct efficient, liver-specific expression in transgenic mice," Genes and Devel. 1:268-276 (1987).
Puente et al., "Human and mouse proteases: a comparitive genomic approach," Nat Rev Genet 544-558 (2003).

(56) References Cited

OTHER PUBLICATIONS

Puente, X. and C. Lopez-Otin, A genomic analysis of rat proteases and protease inhibitors. Genome Biol 14:609-622 (2004).
Querleux et al., "Anatomy and physiology of subcutaneous adipose tissue by in vivo magnetic resonance imaging and spectroscopy: relationships with sex and presence of cellulite," Skin Research and Technology 8:118-124 (2002).
Rawlings, A., "Cellulite and its treatment," Int. J Cos. Science 28:175-190 (2006).
Readhead et al., "Expression of a myelin basic protein gene in transgenic shiverer mice: correction of the dysmyelinating phenotype," Cell 48:703-712 (1987).
Reddy, G. and C. Enwemeka, "A simplified method for the analysis of hydroxyproline in biological tissues," Clinical Biochemistry 29:225-229 (1996).
Roberts et al., "Chemistry for peptide and protein PEGylation," Advanced Drug Delivery Review 54:459-476 (2002).
Rojas-Espinosa et al., "Purification and properties of the cathepsin D types proteinase from beef and rabbit lung and its identification in macrophages," Infection and Immunity 8:1000-1008 (1973).
Ross et al., "Serine proteases and their homologs in the *Drosophila melanogaster* genome: an initial analysis of sequence conservation and phylogenetic relationships," Gene 304:117-131 (2003).
Ruoslahti, E. and Y. Yamaguchi, "Proteoglycans as modulators of growth factor activities," Cell 64(5):867-869 (1991).
Sarath et al. "Protease Assay Methods," in Proteolytic Enzymes: A Practical Approach. Ed. Robert J. Beynon and Judith S. Bond. Oxford University Press, 2001. pp. 45-76.
Sato et al., "Cloning and expression in *Escherichia coli* of the gene encoding the Proteus vulgaris chondroitin ABC lyase," Appl. Microbiol. Biotechnol. 41(1):39-46 (1994).
Sato, H., "Enzymatic procedure for site-specific pegylation of proteins," Adv. Drug Deliv. Rev. 54:487-504 (2002).
Schwartz and Dayhoff, eds., Atlas of Protein Sequence and structure, National Biomedical Research Foundation, pp. 353-358 (1979).
Shani, M., "Tissue-specific expression of rat myosin light-chain," Nature 314:283-286 (1985).
Smith, T. and M. Waterman, "Comparison of biosequences," Advances in Applied Mathematics 2:482-489 (1981).
Smith, W., Cosmetics and Toiletries 109:41-48 (1994).
Southan C. A genomic perspective on human proteases as drug targets. Drug Discov Today 2001;6:681-688.
Springman et al., "Multiple modes of activation of latent human fibroblast collagenase: evidence for the role of a Cys73 active-site zinc complex in latency and a "cysteine switch" mechanism for activation," Proc Natl Acad Sci USA. 87:364-368 (1990).
Stroud et al., "Mechanisms of zymogen activation," Ann. Rev. Biophys. Bioeng. 6:177-193 (1977).
Swift et al., "Tissue-specific expression of the rat pancreatic elastase I gene in transgenic mice," Cell 38:639-646 (1984).
Thomas Kreis and Ronald Cale, Extracellular Matrix, Anchor and Adhesion Proteins, Oxford University Press (1999) pp. 515-523.
Tkalec et al., "Isolatioh and expression in *Escherichia coli* of cslA and cslB, genes coding for the chondroitin sulfate-degrading enzymes chondroitinase AC and chondroitinase B, respectively, from Flavobacterium heparinum," Applied and Environmental Microbiology 66(1):29-35 (2000).
Tredget et al., "Determination of 4-hydroxyproline in collagen by gas chromatography/mass spectrometry," Anal. Biochem. 190:259-265 (1990).
Tsubery et al., "Prolonging the action of protein and peptide drugs by a novel approach of reversible polyethylene glycol modification," J Biol. Chem 279(37):38118-38124 (2004).
Tsuda et al., "Substrate specificity studies of flavobacterium chondroitinase C and heparitinases towards the glycosaminoglycan—protein linkage region. Use of a sensitive analytical method developed by chromophore-labeling of linkage glycoserines using dimethylaminoazobenzenesulfonyl chloride," Eur. J. Biochem. 262:127-133 (1999).

Turk et al., "Lysomal cysteine proteases: facts abnd opportunities," The EMBO Journal, 20:4629-4633 (2001).
Tyle, P., "Iontophoretic devices for drug delivery," Pharmaceutical Research 3(6):3-18 (1986).
UniProKB/Swiss-Prot entry P38567 found at : www.expasy.org/uniprot/P38567 [accessed on May 6, 2009] [6 pages].
Van der Rest, M. and R. Garrone, "Collagen family of proteins," FASEB J., 5:2814-2823 (1991).
Veronese et al., "An improved procedure for the synthesis of branched polyethylene glycols (PEGs) with the reporter dipeptide Met-betaAla for protein conjugation," Bioorg. Med. Chem. Lett. 12:177-180 (2002).
Visse, R. and H. Nagase, "Matrix metalloproteinases and tissue inhibitors of metalloproteinases: structure, function and biochemistry," Cir. Res., 92:827-839 (2003).
Wagner et al., "Nucleotide sequence of the thymidine kinase gene of herpes simplex virus type 1," Proc. Natl. Acad. Sci. USA 78:1441-1445 (1981).
Warden, S., "Animal models for the study of tendinopathy," Br. J. Sports Med. 41:232-240 (2006).
Wight et al., "The role of proteoglycans in cell adhesion, migration and prolifereation," Curr. Opin. Cell Biol. 4:793-801 (1992).
Wight, T., "Cell biology of arterial proteoglycans," Arteriosclerosis 9:1-20 (1989).
Wilkinson et al., "A nonradioactive assay for type IV collagen degradation," Anal. Biochem. 185:294-296 (1990).
Yamagata et al., "Purification and properties of bacterial chondroitinases and chondrosulfatases," J. Biol. Chem. 243:1523-1535 (1968).
Yamamoto et al., "Identification of a functional promoter in the long terminal repeat of Rous sarcoma virus," Cell 22:787-797 (1980).
Yamamoto, T. "Characteristics of animal models for scleroderma," Cur. Rheum. Rev. 1:101-109 (2005).
Yang et al., "Purification and characterization of heparinase from Flavobacterium heparinum," J. Biol. Chem. 160(30):1849-1857 (1985).
U.S. Appl. No. 12/378,969, filed Feb. 20, 2009.
U.S. Appl. No. 12/378,984, filed Feb. 20, 2009.
U.S. Appl. No. 12/381,844, filed Mar. 16, 2009.
U.S. Appl. No. 12/386,249, filed Apr. 14, 2009.
U.S. Appl. No. 12/386,222, filed Apr. 14, 2009.
U.S. Appl. No. 12/386,473, filed Apr. 16, 2009.
U.S. Appl. No. 12/387,225, filed Apr. 28, 2009.
PCT/US09/001486, Mar. 6, 2009.
PCT/US09/001455, Mar. 6, 2009.
PCT/US09/001670, Mar. 16, 2009.
PCT/US09/002353, Apr. 14, 2009.
PCT/US09/002352, Apr. 14, 2009.
PCT/US09/002625, Apr. 28, 2009.
U.S. Appl. No. 13/068,025, filed Apr. 29, 2011.
Du et al., "Calcium influx and activation of calpain I mediated acute reactive gliosis in injured spinal cord," Experimental Neurology 157(1):96-105 (1999).
Godiksen, H. and H. Nielsen, "New method to discriminate between cathepsin B and cathepsin L in crude extracts from fish muscle based on a simple acidifiation procedure," International Journal of Food Science and Technology 42(1):102-106 (2007).
Halozyme Therapeutics, Analyst and Investor Meeting presentations including by Lim, J., "Introduction and strategic review," Little, R., "Leveraging the technology across multiple partners," Frost, G., "Discovery and early development pipeline update," and D. Muchmore, "Ultrafast insulin-PH2O program-where we are going," Presented Oct. 15, 2009 in New York. (88 pages).
Kundu et al, "Temporal-Spatial Control of Tissue Contouring with Extracellular pH-Modulated rHuCathepsin-L," International Investigative Dermatology Conference, May 14-16, 2008, Kyoto Japan, 1 page.
News Release, Halozyme Therapeutics Inc. Q4 2007 Earnings Call Transcript from Mar. 14, 2008 Earnings Call, retrieved from the Internet:<URL: seekingalpha.com/article/68609-halozyme-therapeutics-q4-2007-earnings-call-transcript>, [accessed on Jun. 24, 2009] [12 pages].

(56) References Cited

OTHER PUBLICATIONS

News Release, Halozyme Therapeutics Inc., Q1 2008 Earnings Call Transcript from May 9, 2008 Earnings Call, retrieved from the Internet:<URL: seekingalpha.com/article/76655-halozyme-therapeutics-inc-q1-2008-earnings-call-transcript>. [accessed on Jun. 25, 2009] [14 pages].
Pinkstaff et al., "Evaluation of the compatibility and pharmacokinetics of co-formulated biologics with recombinant human hyaluronidase: Dose Response," American Association of Pharmaceutical Scientists Conference, Jun. 2006, San Antonio, TX, 3 pages.
Runger et al., "Role of cathepsin K in turnover of the dermal extracellular matrix during scar formation" Journal of Investigative Dermatology, 127(2):293-297 (2007).
"Say Goodbye to Dimpled Thighs," Third Age News Service citing source as Society for Advacement of Education/USA Today. Retrieved from the Internet<URL:thirdage.com/print/29617, [retrieved on Mar. 11, 2010] [2 pages].
"The most effective way to lose cellulite," Cellulitehometreatments.com web page, Retrieved from the Internet:<URL: cellulitehometreatments.com, [retrieved on Mar. 11, 2010] [6 pages].
Actizyme E3M product listing posted on Active Organics web site. Retrieved from the Internet:<URL: activeorganics.com/actizyme.htm, [retrieved on Apr. 13, 2010] [2 pages].
Chung et al., "Collagenase unwinds triple-helical collagen prior to peptide bond hydrolysis," The EMBO Journal 23:3020-3030 (2004).
Fasciglione et al., "pH- and temperature-dependence of functional modulation in metalloproteinases. A comparison between neutrophil collagenase and gelatinases A and B," Biophys J. 79(4):2138-2149 (2000).
Grant et al., "The Activation of Human Skin Fibroblast Procollagenase," J. Biol Chem 262:5886-5889 (1987).
Halozyme Therapeutics, "Exclusive Distribution Agreement," Aug. 13, 2004, 13 pages.
Halozyme Therapeutics, "Non-Exclusive Distribution Agreement," Apr. 13, 2004, 22 pages.
Halozyme Therapeutics, "Non-Exclusive Distribution Agreement," Feb. 9, 2004, 21 pages.
Halozyme Therapeutics, "Non-Exclusive Distribution Agreement," Jan. 30, 2004, 19 pages.
Hogan et al., "Delivery of active collagenase to skin using a lorentz-force actuated needle-free injector," Conf Proc IEEE Eng Med Biol Soc. 1:5611-5616 (2006).
Krane et al., "Different Collagenase Gene Products have Different Roles in Degradation of type I collagen," Journal of Biological Chemistry 271(45):28509-28515 (1997).
Kundu et al, "Temporal-Spatial Control of Tissue Contouring with Extracellular pH-Modulated rHuCathepsin-L," Presentation in Lisbon Jun. 2008, 15 pages.
Lauer-Fields et al., "Identification of specific hemopexin-like domain residues that facilitate matrix metalloproteinase collagenolytic activity," Journal of Biological Chemistry 284(36):24017-24024 (1997).
News Release, Halozyme Therapeutics Inc. Q3 2008 Earnings Call Transcript retrieved from the Internet:<URL: seekingalpha.com/article/106797-halozyme-therapeutics-inc-q3-2008-earnings-call-transcript?page=-1 [accessed on Nov. 6, 2009] [9 pages].
News Release, Halozyme Therapeutics Inc. Q3 2009 Earnings Call Transcript retrieved from the Internet:<URL: seekingalpha.com/article/171883-halozyme-therapeutics-inc-q3-2009-earnings-call-transcript?page=-1 [accessed on Nov. 6, 2009] [11 pages].
News Release, Halozyme Therapeutics Inc., "Halozyme Therapeutics Reports 2008 Second Quarter Financial Results" Aug. 8, 2008, retrieved from the Internet<URL: sec.gov/Archives/edgar/data/1159036/000129993308003838/exhibit1.htm, [retrieved on Mar. 31, 2010] [5 pages].
News Release, Halozyme Therapeutics Reports Fourth Quarter and Year End 2009 Financial Results, Mar. 12, 2010, retrieved from the Internet:<URL: phx.corporate-ir.net/phoenix.zhtml?c=175436&p=irol-newsArticle_print&ID=1401856&highlight= [accessed on Nov. 6, 2009] [5 pages].
Pugliese, P., "A new look at cellulite, Part 1," published Jun. 26, 2008 from the Jul. 2008 issue of Skin inc. Magazine. 5 pages.
Ra, H. and W. Parks, "Control of matrix metalloproteinase," Matrix Biol (8):587-596 (2007).
Sepper et al., "Potentiative effects of neutral proteinases in an inflamed lung: relationship of.neutrophil procollagenase (proMMP-8) to plasmin, cathepsin G and tryptase in bronchiectasis in vivo," Eur. Respir. J. 10:2788-2793 (1997).
Shamamian et al., "Activation of progelatinase A (MMP-2) by neutrophil elastase, cathepsin G, and proteinase-3: a role for inflammatory cells in tumor invasion and angiogenesis," J. Cell Physiol 189:197-206 (2001).
U.S. Appl. No. 12/660,894, filed Mar. 5, 2010.
Bohley et al., "Intracellular protein turnover," in S. Holzera nd H. Tschcsche (Eds.) Biological Functions of Proteinasc., Berlin:Springer-Verlag, pp. 17-34 (1979).
Van Der Rest, M. and R. Garrone, "Collagen family of proteins," FASEB J 5:2814-2823 (1991).
Letter/Written Disclosure of the Information Disclosure Statement for the above referenced application, mailed on Jul. 29, 2011 (2 pages).
Response of Apr. 30, 2010 to Written Opinion, issued Feb. 4, 2010 to corresponding International Application No. PCT/US2009/001486, 38 pages.
Response of Jan. 6, 2011 to Written Opinon, issued Jun. 7, 2010, for related International Application No. PCT/US2010/026444, 14 pages.
International Preliminary Report on Patentability, issued Apr. 21, 2011, for related International Application No. PCT/US2010/026444, 9 pages.
Halozyme Therapeutics, Securities and Exchange Commission Form 8-K, Jan. 10, 2011 [43 pages].
Halozyme Therapeutics Website [on-line], Halozyme Therapeutics Inc. [retrieved on Jul. 25, 2011] [retrieved from the Internet<URL:halozyme.com] [36 pages].
News Release [on-line], Halozyme Therapeutics Inc., "First quarter 2011 financial results conference call transcript," published May 6, 2011, [retrieved on Jul. 25, 2011] [retrieved from the Internet<URL:phx.corporate-ir.net/External.File?item=UGFyZW 50SUQ9NDI5MDMwfENoaWxkSUQ9NDQ2MjI4FR5cGU9 MQ==&t=1] [12 pages].
Frost, G., Investor Presentation Jefferies 2011 Global Healthcare Conference, Jun. 9, 2011, New York, NY, 22 pages.
Halozyme Therapeutics, J.P. Morgan 29th Annual Healthcare Conference Presentation, Jan. 12, 2011, 35 pages.
Halozyme Therapeutics, "Matrix therapies for life," presented by Muchmore, D. and R. Uhl at Canaccord Cardiovascular, Diabetes & Obesity Conference, Dec. 8, 2010, 38 pages.
Halozyme Therapeutics, Analyst and Investor Meeting presentations, "Matrix Therapeutics for Life" presented Oct. 14, 2010 in New York, NY., Presentation, 124 pages.
Rana et al., "Effect of matrix-degrading enzymes on disc height, T2 values and biomechanical properties of intervertebral discs: implications for chemonucleolysis." Trans Orthop Res Soc. 36:0687, 2011. Abstract. 2 pages.
Office Action, mailed Apr. 2, 2013, in connection with Japanese Patent Application No. 2010-549679 [English translation], 4 pages.
Examination Report, issued Mar. 21, 2013 (received Apr. 17, 2013), in connection with Korean Patent Application No. 10-2010-7022203 [English Translation], 9 pages.
Fagotto, F., "Yolk degradation in tick eggs:III. Developmentally regulated acidification of the yolk spheres," Development, Growth and Differentiation. 33(1):57-66 (1991).
Turk et al., "Acidic pH as a physiological regulator of human cathepsin L activity," Eur J Biochem. 259(3):926-932 (1999).

(56) References Cited

OTHER PUBLICATIONS

Derwent English abstract for Japanese patent JP-6-192124, published Jul. 12, 1994, entitled: "Blood cell increasing prepn. with mega-karyocyte potentiating activity-contains cathepsin L derived from human fibroblast," Dialog File No. 351, Accession No. 6869888, 2 pages.
Goldberg et al., "Human fibroblast collagenase. Complete primary structure and homology to an oncogene transformation induced rat protein," J Biol Chem. 261(14):6600-6605 (1986).
Kaar, J., "Using enzyme structure-environment-activity relationships to enhance biocatalyst utility," University of Pittsburgh, URN: etd-10152007-152622 (2008) [172 pages]. Dissertation.
Translation, dated Feb. 11, 2014, of Official Action, issued Dec. 17, 2013, in connection with Colombian Patent Application No. 13-151.939, 4 pages.
Translation, dated Mar. 5, 2014, of Final Office Action, issued Jan. 28, 2014, in connection with Colombian Patent Application No. 10-111.097, 6 pages.
News Release, "Halozyme Therapeutics to Present at the 31st Annual J.P. Morgan Healthcare Conference," Published Jan. 3, 2013 [online][Retrieved Jan. 17, 2013][Retrieved from the Internet: URL:http://www.halozyme.com/Investors/News-Releases/News-Release-Details/2013/Halozyme-Therapeutics-to-Present-at-the-31st-Annual-JP-Morgan-Healthcare-Conference1132508/default.aspx, 2 pages.
Frost, G. I., "Halozyme Therapeutics, Inc. Thinking outside the cell," presented at J. P. Morgan Healthcare Conference on Jan. 10, 2013. Presentation. 24 pages.
Halozyme Therapeutics Investor Presentation, "Halozyme Therapeutics, Inc.: Thinking outside the cell," Presented on Oct. 2, 2012 [online][retrieved on Oct. 11, 2012] Retrieved from:<URL:sec.gov/Archives/edgar/data/1159036/000119312512412748/d419091dex991.htm [82 pages].
Transcript, "Halozyme Therapeutics's Ceo hosts analyst/investor day conference call (Transcript)," Published on Oct. 2, 2012 [online][retrieved on Oct. 25, 2011] Retrieved from:<URL:seekingalpha.com/article/901141-halozyme-therapeutics-s-ceo-hosts-analyst-investor-day-conference-call-transcript?part=single [49 pages].
Examination Report, issued Mar. 13, 2012 in connection with Chilean Patent Application No. 541-2009, 3 pages.
Final Office Action, issued May 24, 2012 in connection with U.S. Appl. No. 12/386,473, 12 pages.
Instructions for response to Examination Report, issued Mar. 13, 2012 in connection with Chilean Patent Application No. 541-2009, 28 pages.
Office Action, issued Jun. 7, 2012 (received Aug. 8, 2012) in connection with Israeli Patent Application No. 207293 (3056IL) [English translation], 4 pages.
Examiner's Report, issued Nov. 19, 2012, in connection with Canadian Patent Applicaton No. 2,718,549, 4 pages.
Notice of Acceptance, dated Oct. 24, 2013, in connection with Australian Patent Application No. 2009220094, 2 pages.
Office Action, issued Nov. 29, 2013, in connection with Korean Patent Application No. 10-2013-7024682 [English Translation], 9 pages.
Examination Report and Search Report, received Aug. 23 in connection with Taiwanese Patent Application No. 098107084 (3056TW) [English Translation], 5 pages.
Runger et al., "Role of cathepsin K in turnover of the dermal extracellular matrix during scar formation" Journal of Investigative Dermatology; 127(2):293-297 (2007).
U.S. Appl. No. 13/200,666, filed Sep. 27, 2011.
U.S. Appl. No. 13/385,528, filed Feb. 22, 2011.
Letter/Written Disclosure of the Supplemental Information Disclosure Statement for the above-referenced application, mailed on Apr. 27, 2012 2 pages.
Halozyme Website, "HTI-501," [published online][retrieved on Apr. 23, 2012] Retrieved from:<URL:halozyme.com/Products-And-Pipeline/Pipeline/HTI-501/default.aspx [1 page].
News Release, Halozyme Therapeutics, Inc., "HTI-501 Data Support Commencement of Phase 2 Portion of Clinical Trial," Published on Jan. 31, 2012 [online][retrieved on Apr. 23, 2012] Retrieved from:<URL://www.halozyme.com/Investors/News-Releases/News-Release-Details/2012/HTI-501-Data-Support-Commencement-of-Phase-2-Portion-of-Clinical-Trial1128090/default.aspx [3 pages].
Office Action, issued Apr. 29, 2011, in connection with related U.S. Appl. No. 12/378,984, 24 pages.
Response to Office Action, issued Apr. 29, 2011, in connection with related U.S. Appl. No. 12/378,984, 26 pages.
Office Action, issued Aug. 24, 2011, in connection with related U.S. Appl. No. 12/386,222, 19 pages.
Office Action, issued Feb. 15, 2012, in connection with related U.S. Appl. No. 12/378,984, 25 pages.
Office Action, issued Oct. 11, 2011, in connection with related U.S. Appl. No. 12/386,273, 12 pages.
Response to Office Action, issued Oct. 11, 2011, in connection with related U.S. Appl. No. 12/386,273, 19 pages.
Examiner's Report, issued Apr. 13, 2012, in connection with corresponding Australian Patent Application No. 2009220094, 3 pages.
Examination Report, issued Oct. 2, 2014, in connection with European Patent Application No. 09716286.1 and accompanying documents, 123 pages.
Notice of Result of Reconsideration Before Trial, issued Aug. 4, 2014, in connection with Korean Patent Application No. 10-2010-7022203 [English translation and original document in Korean] and accompanying documents, 38 pages.
Letter/Written Disclosure of the Supplemental Information Disclosure Statement for the above-referenced application, filed Nov. 12, 2014, 3 pages.
Letter/Written Disclosure of the Supplemental Information Disclosure Statement for the above-referenced application, mailed Mar. 23, 2015, 2 pages.
Halozyme Therapeutics, "United States Securities and Exchange Commission, form 10-K, Part I" for fiscal year ending Dec. 31, 2013, filed Feb. 28, 2014 [32 pages].
Halozyme Therapeutics, "United States Securities and Exchange Commission, form 10-K, Part I," for fiscal year ending Dec. 31, 2012, filed Mar. 1, 2013 [30 pages].
News Release, Halozyme Therapeutics, Inc., "Halozyme Announces Positive Results From Phase 1/2 Clinical Trial in Cellulite With HTI-501," Published on Mar. 25, 2014 [online], Retrieved from: <URL:finance.yahoo.com/news/halozyme-announces-positive-results-phase-120000296.html [retrieved on Mar. 25, 2014] [2 pages].
Torley, H., "Halozyme Therapeutics, Inc. The next chapter begins: creating value through growth," Presented at the 32nd Annual J.P. Morgan Healthcare Conference Jan. 2014, 26 pages.
Office Action, issued Sep. 15, 2014, in connection with corresponding U.S. Appl. No. 14/243,805, 16 pages.
Response, filed Dec. 15, 2014, to Office Action, issued Sep. 15, 2014, in connection with corresponding U.S. Appl. No. 14/243,805, 146 pages.
Office Action, issued Dec. 23, 2014, in connection with corresponding U.S. Appl. No. 14/243,805, 8 pages.
Response, dated Oct. 14, 2013, to Examiner's Report, issued Apr. 13, 2012, in connection with corresponding Australian Patent Application No. 2009220094, 38 pages.
Examiner's Report, issued Jun. 27, 2014, in connection with corresponding Australian Patent Application No. 2013202011, 92 pages.
Response, dated May 21, 2014, to Examiner's Report, issued Nov. 19, 2012, in connection with corresponding Canadian Patent Application No. 2,718,549, 61 pages.
Response, dated Jan. 30, 2015, to Examiner's Report, issued Jul. 31, 2014, in connection with corresponding Canadian Patent Application No. 2,718,549, 42 pages.
Instructions, dated Jul. 13, 2013, for response to Office Action, received Feb. 14, 2013, in connection with corresponding Chilean Patent Application No. 541-2009, 25 pages.

(56) References Cited

OTHER PUBLICATIONS

Notice of Opposition, dated Jul. 11, 2014, in connection with corresponding Chilean Patent Application No. 2070-2013, 2 pages.
Instructions, dated Sep. 6, 2014, for response to Notice of Opposition, dated Jul. 11, 2014, in connection with corresponding Chilean Patent Application No. 2070-2013, 25 pages.
Instructions, dated Mar. 10, 2014, for response to Official Action, issued Jan. 28, 2014, in connection with corresponding Columbian Patent Application No. 10-111.097, 44 pages.
Instructions, dated Apr. 28, 2014, for response to Official Action, issued Dec. 17, 2013, in connection with corresponding Colombian Patent Application No. 13-151.939, 12 pages.
Letter, dated Feb. 17, 2015, proving translation and enclosing an original Official Action, issued Jan. 30, 2015, in connection with corresponding Colombian Patent Application No. 13-151.939, 187 pages.
Response, dated Apr. 7, 2013, to Office Action, issued Jun. 7, 2012 in connection with corresponding Israeli Patent Application No. 207293, 20 pages.
Instructions, dated Sep. 27, 2013, for response to Office Action, dated Apr. 2, 2013, in connection with corresponding Japanese Patent Application No. 2010-549679, 19 pages.
Final Official Action, mailed Jun. 24, 2014, in connection with corresponding Japanese Patent Application No. 2010-549679 [English translation and original document in Japanese], 174 pages.
Instructions, dated Dec. 17, 2014, for response to Final Official Action, mailed Jun. 24, 2014, in connection with corresponding Japanese Patent Application No. 2010-549679, 15 pages.
Letter, dated Feb. 5, 2015, enclosing Decision to Grant, issued Feb. 3, 2015, in connection with corresponding Japanese Patent Application No. 2010-549679, 4 pages.
Instructions, dated Sep. 9, 2013, for response to Examination Report, issued Mar. 21, 2013, in connection with corresponding Korean Patent Application No. 10-2010-7022203, 27 pages.
Instructions, dated Jun. 23, 2014, for arguments for appeal in response to Office Action, issued Feb. 27, 2014, in connection with corresponding Korean Patent Application No. 10-2010-7022203, 19 pages.
Instructions, dated May 27, 2014, for response to Office Action, issued Nov. 29, 2013, in connection with corresponding Korean Patent Application No. 10-2013-7024682, 31 pages.
Office Action, issued Oct. 30, 2014, in connection with corresponding Korean Patent Application No. 10-2013-7024682 [English translation and original document in Korean], 311 pages.
Letter, dated Jun. 18, 2014, providing English translation of Office Action, issued May 27, 2014, in connection with corresponding Mexican Patent Application No. MX/a/2010/009806 [and original Office Action in Spanish], 95 pages.
Instructions, dated Sep. 26, 2014, for response to Office Action, issued May 27, 2014, in connection with corresponding Mexican Patent Application No. MX/a/2010/009806, 96 pages.
Letter, dated Feb. 10, 2015, providing English translation of and enclosing Office Action, issued Jan. 27, 2015, in connection with corresponding Mexican Patent Application No. MX/a/2010/009806, 7 pages.
Instructions, dated Jan. 20, 2013, for response to Examination Report and Search Report, received Aug. 23 in connection with corresponding Taiwanese Patent Application No. 098107084, 48 pages.
Letter/Written Disclosure of the supplement Information Disclosure Statement for the above-referened application, filed herewith, Oct. 2, 2015, 2 pages.
Response, filed Mar. 23, 2015, to Office Action, issued Dec. 23, 2014, in connection with U.S. Appl. No. 14/243,805, 17 pages.
Final Office Action, mailed Apr. 2, 2015, in connection with U.S. Appl. No. 14/243,805, 16 pages.
Response, filed Apr. 6, 2015, to Office Action, issued Feb. 4, 2015, in connection with Mexican Patent Application No. MX/a/2010/009806, [English instructions and document as filed in Spanish] 26 pages.
Response, filed Apr. 13, 2015, to Examination Report, issued Oct. 2, 2014, in connection with European Patent Application No. 09716286.1, 19 pages.
Response, filed May 14, 2015, to Examiner's Report, issued Jun. 27, 2014, in connection with Australian Patent Application No. 2013202011, 16 pages.
Letter, dated Aug. 2, 2015, reporting Resolution, dated May 29, 2015, in connection with Columbian Patent Application No. 10-111.097, 7 pages.
Response, filed Aug. 19, 2015, to Office Action, issued May 21, 2015, in connection with Korean Patent Application No. 10-2015-7004822 [English instructions and document as filed in Korean], 15 pages.
Notice of Grant, issued Oct. 1, 2015, in connection with Australian Patent Application No. 2013202011, 1 page.
Letter/Written Disclosure of the Supplemental Information Disclosure Statement for the above-referenced application, filed herewith Jun. 30, 2015, 4 pages.
Office Action, issued Apr. 13, 2015 and received Jun. 3, 2015, in connection with Chilean Patent Application No. 2070-2013 [English translation and original document in Spanish], 12 pages.
Notice of Acceptance, issued Jun. 9, 2015 and received Jun. 10, 2015, in connection with Australian Patent Application No. 2013202011, 2 pages.
Office Action, issued May 21, 2015 and received Jun. 18, 2015, in connection with Korean Patent Application No. 10-2015-7004822 [English translation and original document in Korean], 5 pages.
Letter, received Jun. 25, 2015, reporting Notice of Allowance, in connection with Mexican Patent Application No. MX/a/2010/009806, 1 page.
Letter/Written Disclosure of the Supplemental Information Disclosure Statement for the above-referenced application, filed herewith on Apr. 15, 2016, 3 pages.
Letter, dated Mar. 30, 2016, reporting Office Action, issued Feb. 11, 2016, in connection with Chilean Patent Application No. 2070-2013 [English letter and original document in Spanish], 11 pages.
Official Action, issued Jan. 27, 2016, and received Mar. 17, 2016, in connection with Israeli Patent Application No. 207293 [English translation], 4 pages.
Letter/Written Disclosure of the Supplemental Information Disclosure Statement for the above-referenced application, filed herewith on Jun. 13, 2016, 2 pages.
Decision to Grant a European Patent pursuant to Article 97(1) EPC, issued May 6, 2016, in connection with European Patent Application No. 09716286.1, 2 pages.
Letter/Written Disclosure of the Supplemental Information Disclosure Statement for the above-referenced application, filed herewith on Jul. 13, 2016, 3 pages.
Official Action, issued May 16, 2016 and received Jun. 14, 2016, in connection with Colombian Patent Application No. 10-111.097 [English translation and original document in Spanish], 11 pages.
Decision to Grant, dated Jun. 24, 2016 and received Jul. 4, 2016, in connection with Korean Patent Application No. 10-2015-7004822 [English translation and original document in Korean], 3 pages.
Office Action, issued Jun. 20, 2016 and received Jul. 11, 2016, in connection with Mexican Patent Application No. MX/a/2014/012592 [English translation and original document in Spanish], 4 pages.
Examination Report, issued Oct. 2, 2014, in connection with European Patent Application No. 09716286.1, 5 pages.
Examiner's Report, issued Jul. 31, 2014, in connection with Canadian Patent Application No. 2,718,549, 4 pages.
Notice of Result of Reconsideration Before Trial, issued Aug. 4, 2014, in connection with Korean Patent Application No. 10-2010-7022203 [English translation and original document in Korean], 6 pages.
Letter/Written Disclosure of the Supplemental Information Disclosure Statement for the above-referenced application, filed Oct. 28, 2014, 3 pages.
Letter/Written Disclosure of the Supplemental Information Disclosure Statement for the above-referenced application, filed herewith on Feb. 12, 2016, 3 pages.

(56) References Cited

OTHER PUBLICATIONS

Office Action, issued Dec. 18, 2015, in connection with Korean Patent Application No. 10-2015-7004822 [English translation and original document in Korean], 5 pages.
Communication under Rule 71(3) EPC (Intention to Grant), issued Dec. 18, 2015, in connection with European Patent Application No. 09716286.1, 5 pages.
Letter/Written Disclosure of the Supplemental Information Disclosure Statement for the above-referenced application, filed Jun. 22, 2017, 2 pages.
Ohman and Vahlquist, "In vivo studies concerning a pH gradient in human stratum corneum and upper epidermis," Acta. Derm. Venereol. 74(5):375-379 (1994).
Vaughn, "Phase 1 Clinical Study (Preliminary Results): Conditionally Active Recombinant Human Cathepsin L (CAB-rHuCatL)." 2012 World Congress of Cosmetic Dermatology, Jan. 31-Feb. 4, 2012, Cancun, Mexico (presentation), 16 pages.
Preliminary Amendment and Request for Continued Examination, filed Oct. 2, 2015, in connection with U.S. Appl. No. 14/243,805, 23 pages.
Final Office Action, mailed Dec. 3, 2015, in connection with U.S. Appl. No. 14/243,805, 18 pages.
Notice of Appeal, filed Mar. 3, 2016, in connection with U.S. Appl. No. 14/243,805, 1 page.
Appeal Brief, filed Jul. 5, 2016, in connection with U.S. Appl. No. 14/243,805, 40 pages.
Reply Brief, submitted Dec. 6, 2016, to Examiner's Answer, mailed Oct. 6, 2016, to Appeal Brief, filed Jul. 5, 2016, in connection with U.S. Appl. No. 14/243,805, 24 pages.
Patent Trial and Appeal Board Docketing Notice, dated Jan. 6, 2017, in connection with U.S. Appl. No. 14/243,805, 2 pages.
Decision on Appeal, mailed Mar. 29, 2017, in connection with U.S. Appl. No. 14/243,805, 10 pages.
Letter, mailed to the U.S. Patent and Trademark Office on May 24, 2017, in connection with U.S. Appl. No. 14/243,805, 1 page.
Notice of Allowance, mailed Jun. 2, 2017, in connection with U.S. Appl. No. 14/243,805, 7 pages.
Notice of Allowance, issued Feb. 2, 2016, in connection with Canadian Patent Application No. 2,718,549, 1 page.
Response, filed Oct. 14, 2015, to Office Action, issued Apr. 13, 2015, in connection with Chilean Patent Application No. 2070-2013 [English instructions and document as filed in Spanish], 8 pages.
Response, filed May 29, 2016, to Office Action, issued Jan. 27, 2016, in connection with Israeli Patent Application No. 207293 [English translation], 4 pages.
Decision to Reject, issued Feb. 27, 2014, in connection with Korean Patent Application No. 10-2010-7022203 [English translation], 5 pages.
Response, filed Feb. 18, 2016, to Office Action, issued Dec. 18, 2015, in connection with Korean Patent Application No. 10-2015-7004822 [English instructions and document as filed in Korean], 26 pages.
Letter/Written Disclosure of the Supplemental Information Disclosure Statement for the above-referenced application, filed Oct. 5, 2016, 2 pages.
Letter, dated Sep. 30, 2016, reporting Office Action, issued Sep. 3, 2016, in connection with Argentinian Patent Application No. P090100823, 4 pages.
Letter, dated Sep. 8, 2016, reporting Notification Prior to Acceptance, dated Jul. 14, 2016, issued in connection with Israeli Patent Application No. 207293, 4 pages.
Letter/Written Disclosure of the Supplemental Information Disclosure Statement for the above-referenced application, filed Oct. 11, 2016, 3 pages.
Examiner's Answer, mailed Oct. 6, 2016, to Appeal Brief, filed Jul. 5, 2016, in connection with U.S. Appl. No. 14/243,805, 63 pages.
Letter/Written Disclosure of the Supplemental Information Disclosure Statement for the above-referenced application, filed herewith on Jul. 13, 2017, 2 pages.
Letter, received Jun. 22, 2017, reporting Notice of Allowance, dated Apr. 13, 2017, in connection with Chilean Patent Application No. 2013-2070 [English letter and original document in Spanish], 3 pages.
Office Action, dated Jan. 14, 2013 (received Feb. 14, 2013), in connection with corresponding Chilean Patent Application No. 541-2009 [English translation together with Original in the Spanish language], 22 pages.
Notice of Allowance, dated Feb. 27, 2013, in connection with corresponding Taiwanese Patent Application No. 098107084 [English translation together with original document in the Taiwanese language], 3 pages.

\* cited by examiner

CATALYTIC DOMAIN

| | | |
|---|---|---|
| MMP1 | LPRADVDHAIEKAFQLWSNVTPLTFTKVSEGQADIMISFVRGDHRDNS-PFDGPGGNLAH | 164 |
| MMP8 | LSEAEVERAIKDAFELWSVASPLIFTRISQGEADINIAFYQRDHGDNS-PFDGPNGILAH | 162 |
| MMP13 | MTHSEVEKAFKKAFKVWSDVTPLNFTRLHDGIADIMISFGIKEHGDFY-PFDGPSGLLAH | 168 |
| MMP18 | LPQADVETAIQRAFKVWSDVTPLTFTRIYNEVSDIEISFTAGDHKDNS-PFDGSGGILAH | 166 |
| MMP2 | LDPETVDDAFARAFQVWSDVTPLRFSRIHDGEADIMINFGRWEHGDGY-PFDGKDGLLAH | 164 |
| MMP9 | LPRAVIDDAFARAFALWSAVTPLTFTRVYSRDADIVIQFGVAEHGDGY-PFDGKDGLLAH | 171 |
| MMP3 | LPKDAVDSAVEKALKVWEEVTPLTFSRLYEGEADIMISFAVREHGDFY-PFDGPGNVLAH | 166 |
| MMP10 | LPRDAVDSAIEKALKVWEEVTPLITFSRLYEGEADIMISFAVKEHGDFY-SFDGPGHSLAH | 165 |
| MMP11 | LVQEQVRQTMAEALKVWSDVTPLTFTEVHEGRADIMIDFARYWHGDDL-PFDGPGGILAH | 148 |
| MMP7 | LPHITVDRLVSKALNMWGKEIPLHFRKVVWGTADIMIGFARGAHGDSY-PFDGPGNTLAH | 161 |
| MMP26 | MKPSAVKDSIYNAVSIWSNVTPLIFQQVQNGDADIKVSFWQWAHEDGW-PFDGPGGILGH | 156 |
| MMP12 | MNREDVDYAIRKAFQVWSNVTPLKFSKINTGMADILVVFARGAHGDFH-AFDGKGGILAH | 167 |
| MMP19 | LPPHTARAALRQAFQDWSNVAPLITFQEVQAGAADIRLSFHGRQSSYCSNTFDGPGRVLAH | 162 |
| | :  .  *.   *   ***  *  *  :    .  : :    **   .  .*** .  :.* | |

CATALYTIC DOMAIN

Ca BINDING SITE I       FIBRONECTIN TYPE II REPEATS

| | | |
|---|---|---|
| MMP1 | AFQPGPGIGGDAHFDEDERWTN--------------------------------- | 186 |
| MMP8 | AFQPGQGIGGDAHFDAEETWTN--------------------------------- | 184 |
| MMP13 | AFPPGPNYGGDAHFDDDETWTS--------------------------------- | 190 |
| MMP18 | AFQPGNGIGGDAHFDEDETWTK--------------------------------- | 188 |
| MMP2 | AFAPGTGVGGDSHFDDDELWTLGEGQVVRVKYGNADGEYCKFPFLFNGKEYNSCTDTGRS | 224 |
| MMP9 | AFPPGPGIQGDAHFDDDELWSLGKGVVVPTRFGNADGAACHFPFIFEGRSYSACTTDGRS | 231 |
| MMP3 | AYAPGPGINGDAHFDDDEQWTK--------------------------------- | 188 |
| MMP10 | AYPPGPGLYGDIHFDDDEKWTE--------------------------------- | 187 |
| MMP11 | AFFPKTHREGDVHFDYDETWTIG-------------------------------- | 171 |
| MMP7 | AFAPGTGLGGDAHFDEDERWTDG-------------------------------- | 184 |
| MMP26 | AFLPNSGNPGVVHFDKNEHWSA--------------------------------- | 178 |
| MMP12 | AFGPGSGIGGDAHFDEDEFWTT--------------------------------- | 189 |
| MMP19 | ADIPELG---SVHFDEDEFWTEG-------------------------------- | 182 |
| | *  *       *** * *  *: | |

FIG. 1B

|                    | CATALYTIC DOMAIN |
|---|---|
|                    | FIBRONECTIN TYPE II REPEATS |

```
MMP1   ------------------------------------------------------------
MMP8   ------------------------------------------------------------
MMP13  ------------------------------------------------------------
MMP18  ------------------------------------------------------------
MMP2   DGFLWCSTTYNFEKDGKYGFCPHEALFTMGGNAEGQPCKFPFRFQGTSYDSCTTEGRTDG 284
MMP9   DGLPWCSTTANYDTDDRFGFCPSERLYTQDGNADGKPCQFPFIFQGQSYSACTTDGRSDG 291
MMP3   ------------------------------------------------------------
MMP10  ------------------------------------------------------------
MMP11  ------------------------------------------------------------
MMP7   ------------------------------------------------------------
MMP26  ------------------------------------------------------------
MMP12  ------------------------------------------------------------
MMP19  ------------------------------------------------------------
```

|                    | CATALYTIC DOMAIN |
|---|---|
|                    | FIBRONECTIN TYPE II REPEATS |

```
MMP1   ------------------------------------------------------------
MMP8   ------------------------------------------------------------
MMP13  ------------------------------------------------------------
MMP18  ------------------------------------------------------------
MMP2   YRWCGTTEDYDRDKKYGFCPETAMSTVGG-NSEGAPCVFPFTFLGNKYESCTSAGRSDGK 343
MMP9   YRWCATTANYDRDKLFGFCPTRADSTVMGGNSAGELCVFPFTFLGKEYSTCTSEGRGDGR 351
MMP3   ------------------------------------------------------------
MMP10  ------------------------------------------------------------
MMP11  ------------------------------------------------------------
MMP7   ------------------------------------------------------------
MMP26  ------------------------------------------------------------
MMP12  ------------------------------------------------------------
MMP19  ------------------------------------------------------------
```

FIG. 1C

HEMOPEXIN DOMAIN 1

```
MMP1    ----------IGPQTPKACDSK------LTFDAITTIRGEVMFFKDRFYMRTNPFY- 290
MMP8    ----------TGPSTPKPCDPS------LTFDAITTLRGEILFFKDRYFWRRHPQL- 290
MMP13   ----------KHPKTPDKCDPS------LSLDAITSLRGETMIFKDRFFWRLHPQQ- 296
MMP18   ----------TGPSTPSRCDPN------VVFNAVTTMRGELIFFVKRFLWRKHPQA- 294
MMP2    ---TGPT--PTLGPVTPEICKQD-----IVFDGIAQIRGEIFFFKDRFIWRTVTPR- 471
MMP9    PPSAGPTGPTGPPTAGPSTATTVPLSPVDDACNVNIFDAIAEIGNQLYLFKDGKYWRFSEGRG 528
MMP3    ----------PTEPVPPEPGTPANCDPA------LSFDAVSTLRGEILIFKDRHFWRKSLRK- 304
MMP10   ----------PTKSVPSGSEMPAKCDPA-----LSFDAISTLRGEYLFFKDRYFWRRSHWN- 303
MMP11   ----------EIAPLEPDAPPDACEAS------FDAVSTIRGELFFFKAGFVWRLRGGQ- 292
MMP7    ------------------------------------------
MMP26   ----------NPDNSEPALCDPN------LSFDAVTTVGNKIFFFKDRFFWLKVSER- 297
MMP12   ----------ETELPTVPPVTEPSPMPDPCSSELDAMMLGPRGKTYAFKGDYVWTVSDSG- 302
MMP19
```

HEMOPEXIN DOMAIN 2

```
MMP1    -PEVELNFISVFWPQLPNGLEAAYEFADRDEVRFFKGNKYWAVQGQNVLHGYPKDIYSSF 349
MMP8    -QRVEMNFISLFWPSLPTGIQAAYEDFDRDLIFLFKGNQYWALSGYDILQGYPKDISN-Y 348
MMP13   -VDAELFLTKSFWPELPNRIDAAYEHPSHDLIFIFRGRKFWALNGYDILEGYPKKISE-L 354
MMP18   -SEAELMFVQAFWPSLPTNIDAAYENPITEQILVFKGSKYTALDGFDVVQGYPRNIYS-L 352
MMP2    DKPMGPLLVATFWPELPEKIDAVYEAPQEEKAVFFAGNEYWIYSASTLERGYPKPLTS-L 530
MMP9    SRPQGPFLIADKWPALPRKLDSVFEEPLSKKLFFFSGRQVWVYTGASVLG--PRRLDK-L 585
MMP3    -LEPELHLISSFWPSLPSGVDAAYEVTSKDLVFIFKGNQFWAIRGNEVRAGYPRGIHT-L 362
MMP10   -PEPEFHLISAFWPSLPSYLDAAYEVNSRDTVFIFKGNEFWAIRGNEVQAGYPRGIHT-L 361
MMP11   LQPGYPALASRHWQGLPSPVDAAFED-AQGHIWFFQGAQYWVYDGEKPVLGPAPLTEL-- 349
MMP7    ------------------------------------------
MMP26   -PKTSVNLISSLWPTLPSGIEAAYEIEARNQVFLFKDDKYWLISNLRPEPNYPKSIHS-F 355
MMP12   --PGPLFRVSALWEGLPGNLDAAVYSPRTQWIHFFKGDKVWRYINFKMSPGFPKKLNR- 358
MMP19
```

FIG. 1E

HEMOPEXIN DOMAIN 3

| | | |
|---|---|---|
| MMP1 | GFPRTVKHIDAALSEENTGKTYFFVANKYWRYDEYKRSMDPGYPKMIAHDFPGIGHKVDA | 409 |
| MMP8 | GFPSSVQAIDAAVFYR--SKTYFFVNDQFWRYDNQRQFMEPGYPKSISGAFPGIESKVDA | 406 |
| MMP13 | GLPKEVKKISAAVHFEDTGKTLLFSGNQVWRYDDTNHIMDKDYPRLIEEDFPGIGDKVDA | 414 |
| MMP18 | GFPKTVKRIDAAVHIEQLGKTYFFAAKKYWSYDEDKKQMDKGFPKQISNDFPGIPDKIDA | 412 |
| MMP2 | GLPPDVQRVDAAFNWSKNKKTYIFAGDKFWRYNEVKKKMDPGFPKLIADAWNAIPDNLDA | 590 |
| MMP9 | GLGADVAQVTGALRSGRGK-MLLFSGRRLWRFDVKAQMVDPRSASEVDRMFPGVP--LDT | 642 |
| MMP3 | GFPPTVRKIDAAISDKEKNKTYFFVEDKYWRFDEKRNSMEPGFPKQIAEDFPGIDSKIDA | 422 |
| MMP10 | GFPPTIRKIDAAVSDKEKKKTYFFAADKYWRFDENSQSMEQGFPRLIADDFPGVEPKVDA | 421 |
| MMP11 | -GLVRFPVHAALVWGPEKNKIYFFRGRDYWRFHPSTRRVDSPVPRRAT-DWRGVPSEIDA | 407 |
| MMP7 | | |
| MMP26 | GFPNFVKKIDAAVFNPRFYRTYFFVDNQYWRYDERRQMDPGYPKLITKNFQGIGPKIDA | 415 |
| MMP12 | | |
| MMP19 | ----VEPNLDAALYWPLNQKVFLFKGSGYWQWDELARTDFSSYPKPIKGLFTGVPNQPSA | 414 |

HEMOPEXIN DOMAIN 4

| | | |
|---|---|---|
| MMP1 | VFMKDG--FFYFFHGTRQYKFDPKT--KRILTLQKAN-SWFNCRKN------------- | 450 |
| MMP8 | VFQQEH--FFHVFSGPRYYAFDLIA--QRVTRVARGN-KWLNCRYG------------- | 447 |
| MMP13 | VYEKNG--YIYFFNGPIQFEYSIWS--NRIVRVMPAN-SILWC---------------- | 452 |
| MMP18 | AFYYRG--RLYFFIGRSQFEYNINS--KRIVQVLRSN-SWLGC---------------- | 450 |
| MMP2 | VVDLQGGGHSYFFKGAYYLKLENQS-LKSV-KFGSIKSDWLGC----------------- | 631 |
| MMP9 | HDVFQYREKAYFCQDRFYWRVSSRSELNQVDQVGYVTYDILQCPED-------------- | 688 |
| MMP3 | VFEEFG--FFYFFTGSSQLEFDPNA--KKVTHTLKSN-SWLNC---------------- | 460 |
| MMP10 | VLQAFG--FFYFFSGSSQFEFDPNA--RMVTHILKSN-SWLHC---------------- | 459 |
| MMP11 | AFQDADG-YAYFLRGRLYWKFDPVKVKALEGFPRLVGPDFFGCAEPANTFL--------- | 457 |
| MMP7 | | |
| MMP26 | | |
| MMP12 | VFYSKNK-YYYFFQGSNQFEYDFLL--QRITKTLKSN-SWFGC---------------- | 454 |
| MMP19 | AMSWQDG-RVYFFKGKVYWRLNQQLR-VEKGYPRNISHNWMHCRPRTIDTTPSGGNTTPS | 472 |

FIG. 1F

```
MMP1     ------------------------------
MMP8     ------------------------------
MMP13    ------------------------------
MMP18    ------------------------------
MMP2     ------------------------------
MMP9     ------------------------------
MMP3     ------------------------------
MMP10    ------------------------------
MMP11    ------------------------------
MMP7     ------------------------------
MMP26    ------------------------------
MMP12    ------------------------------
MMP19    GTGITLDTTLSATETTFEY----------- 491
```

FIG. 1G

```
MMP1   ------------------------------------------FVLTEGNPRWEQTHLTYRIENYTPD  105
MMP8   ------------------------------------------LTPGNPKWERTNLTYRIRNYTPQ  103
MMP13  ------------------------------------------YNVFPRTLKWSKMNLTYRIVNYTPD  109
MMP18  ------------------------------------------YSTVAKSSAWQKKDLTYRILNFTPD  107
MMP2   ------------------------------------------YNFFPRKPKWDKNQITYRIIGYTPD  105
MMP9   ------------------------------------------FQTFEGDLKWHHHNITYWIQNYSED  112
MMP3   ------------------------------------------FRTFPGIPKWRKTHLTYRIVNYTPD  107
MMP10  ------------------------------------------FSSFPGMPKWRKTHLTYRIVNYTPD  106
MMP11  ------------------------------------------FVLSGGRWEKTDLTYRILRFPWQ   89
MMP7   ------------------------------------------YSLFPNSPKWTSKVVTYRIVSYTRD  102
MMP26  ------------------------------------------TSISPGRCKWNKHTLTYRIINYPHD   97
MMP12  ------------------------------------------FREMPGGPVWRKHYLTYRINNYTPD  108
MMP19  ------------------------------------------YLLLGRWRKKHLTFRIILNLPST   102
                                                   *           :::  ::  .

MMP1   LPRADVDHAIEKAFQLWSNVTPLTFTKVSEGQADIMISFVRGDHRDNS-PFDGPGNLAH  164
MMP8   LSEAEVERAIKDAFELWSVASPLIFTRISQGEADINIAFYQRDHGDNS-PFDGPNGILAH  162
MMP13  MTHSEVEKAFKKAFKVWSDVTPLNFTRLHDGIADIMISFGIKEHGDFY-PFDGPSGLLAH  168
MMP18  LPQADVETAIQRAFAFQVWSDVTPLTFTRIYNEVSDIEISFTAGDHKDNS-PFDGSGILAH  166
MMP2   LDPETVDDAFARAFQVWSDVTPLRFSRIHDGEADIMINFGRWEHGDGY-PFDGKDGLLAH  164
MMP9   LPRAVIDDAFARAFALWSAVTPLTFTRVYSRDADIVIQFGVAEHGDGY-PFDGKDGLLAH  171
MMP3   LPKDAVDSAVEKALKVWEEVTPLTFSRLYEGEADIMISFAVREHGDFY-PFDGPGNVLAH  166
MMP10  LPRDAVDSAIEKALKVWEEVTPLTFSRLYEGEADIMISFAVKEHGDFY-SFDGPGHSLAH  165
MMP11  LVQEQVRQTMAEALKVWSDVTPLTFTEVHEGRADIMIDFARYWHGDDL-PFDGPGILAH  148
MMP7   LPHITVDRLVSKALNMWGKEIPLHFRKVVWGTADIMIGFARGAHGDSY-PFDGPGNTLAH  161
MMP26  MKPSAVKDSIYNAVSIWSNVTPLIFQQVQNGDADIKVSFWQWAHEDGW-PFDGPGILGH  156
MMP12  MNREDVDYAIRKAFQVWSNVTPLKFSKINTGMADILVVFARGAHGDFH-AFDGKGILAH  167
MMP19  LPPHTARAALRQAFQDWSNVAPLTFQEVQAGAADIRLSFHGRQSSYCSNTFDGPGRVLAH  162
       :  .    .  *  **.  ** .**   *  :    *     .       .  ***  . *:*.
```

FIG. 2A

```
MMP1    AFQPGPGIGGDAHFDEDERWTN----------------------------------  186
MMP8    AFQPGQGIGGDAHFDAEETWTN----------------------------------  184
MMP13   AFPPGPNYGGDAHFDDDETWTS----------------------------------  190
MMP18   AFQPGNGIGGDAHFDEDETWTK----------------------------------  188
MMP2    AFAPGTGVGGDSHFDDDELWTLGEGQVVRVKYGNADGEYCKFPFLFNGKEYNSCTDTGRS  224
MMP9    AFPPGPGIQGDAHFDDDELWSLGKGVVVPTRFGNADGAACHFPFIFEGRSYSACTTDGRS  231
MMP3    AYAPGPGINGDAHFDDDEQWTK----------------------------------  188
MMP10   AYPPGPGLYGDIHFDDDEKWTE----------------------------------  187
MMP11   AFFPKTHREGDVHFDYDETWTIG---------------------------------  171
MMP7    AFAPGTGLGGDAHFDEDERWTDG---------------------------------  184
MMP26   AFLPNSGNPGVVHFDKNEHWSA----------------------------------  178
MMP12   AFGPGSGIGGDAHFDEDEFWTT----------------------------------  189
MMP19   ADIPELG--SVHFDEDEFWTEG----------------------------------  182
        *  *             ***  * *:

MMP1    ------------------------------------------------------------
MMP8    ------------------------------------------------------------
MMP13   ------------------------------------------------------------
MMP18   ------------------------------------------------------------
MMP2    DGFLWCSTTYNFEKDGKYGFCPHEALFTMGGNAEGQPCKFPFRFQGTSYDSCTTEGRTDG  284
MMP9    DGLPWCSTTANYDTDDRFGFCPSERLYTQDGNADGKPCQFPFIFQGQSYSACTTDGRSDG  291
MMP3    ------------------------------------------------------------
MMP10   ------------------------------------------------------------
MMP11   ------------------------------------------------------------
MMP7    ------------------------------------------------------------
MMP26   ------------------------------------------------------------
MMP12   ------------------------------------------------------------
MMP19   ------------------------------------------------------------
```

FIG. 2B

```
MMP1   ----------------------------------------------------------------
MMP8   ----------------------------------------------------------------
MMP13  ----------------------------------------------------------------
MMP18  ----------------------------------------------------------------
MMP2   YRWCGTTEDYDRDKKYGFCPETAMSTVGG-NSEGAPCVFPFTFLGNKYESCTSAGRSDGK 343
MMP9   YRWCATTANYDRDKLFGFCPTRADSTVMGGNSAGELCVFPFTFLGKEYSTCTSEGRGDGR 351
MMP3   ----------------------------------------------------------------
MMP10  ----------------------------------------------------------------
MMP11  ----------------------------------------------------------------
MMP7   ----------------------------------------------------------------
MMP26  ----------------------------------------------------------------
MMP12  ----------------------------------------------------------------
MMP19  ----------------------------------------------------------------

MMP1   -------------NFREYNLHRVAAHELGHSLGLSHSTDIGALMYPSYT-F--SG 225
MMP8   -------------TSANYNLFLVAAHEFGHSLGLAHSSDPGALMYPNYA-FRETS 225
MMP13  -------------SSKGYNLFLVAAHEFGHSLGLDHSKDPGALMFPIYT-YTGKS 231
MMP18  -------------TSEIYNLFLVAAHEFGHSLGLSHSTDQGALMYPTYS-NTDPK 229
MMP2   MWCATTANYDDDRKWGFCPDQGYSLFLVAAHEFGHAMGLEHSQDPGALMAPIYT-Y--TK 400
MMP9   LWCATTSNFDSDKKWGFCPDQGYSLFLVAAHEFGHALGLDHSSVPEALMYPMYR-FT--E 408
MMP3   -------------DTTGTNLFLVAAHEIGHSLGLFHSANTEALMYPLYHSLTDLT 230
MMP10  -------------DASGTNLFIVAAHELGHSLGLFHSANTEALMYPLYNSFTELA 229
MMP11  -------------DDQGTDLLQVAAHEFGHVLGLQHTTAAKALMSAFYT-F--RY 210
MMP7   -------------SSLGINFLYAATHELGHSLGMGHSSDPNAVMYPTYG-NGDPQ 225
MMP26  -------------SDTGYNLFLVATHEIGHSLGLQHSGNQSSIMYPTYW-VHDPR 219
MMP12  -------------HSGGTNLFLTAVHEIGHSLGLGHSSDPKAVMFPTYK-YVDIN 230
MMP19  -------------TYRGVNLRIIAAHEVGHALGLGHSRYSQALMAPVYEGY--RP 222
                    .: *.**.** :*:.*      *       :*. .  *

FIG. 2C
```

| | | |
|---|---|---|
| MMP1 | DVQLAQDDIDGIQAIYG-------------------- | 242 |
| MMP8 | NYSLPQDDIDGIQAIYG-------------------- | 242 |
| MMP13 | HFMLPDDDVQGIQSLYG-------------------- | 248 |
| MMP18 | TFQLPQDDINAIQYLYG-------------------- | 246 |
| MMP2 | NFRLSQDDIKGIQELYG-------------------- | 417 |
| MMP9 | GPPLHKDDVNGIRHLYG-------------------- | 425 |
| MMP3 | RFRLSQDDINGIQSLYG-------------------- | 247 |
| MMP10 | QFRLSQDDVNGIQSLYG-------------------- | 246 |
| MMP11 | PLSLSPDDCRGVQHLYG-------------------- | 228 |
| MMP7 | NFKLSQDDIKGIQKLYG-------------------- | 242 |
| MMP26 | TFQLSADDIQRIQHLYG-------------------- | 236 |
| MMP12 | TFRLSADDIRGIQSLYG-------------------- | 247 |
| MMP19 | HFKLHPDDVAGIQALYG-------------------- | 239 |
| | *  :*   *:  :** | |

FIG. 2D

METHODS OF TREATMENT OF COLLAGEN-MEDIATED DISEASES AND CONDITIONS

RELATED APPLICATIONS

Benefit of priority is claimed to U.S. Provisional Application Ser. No. 61/068,667, to Gilbert Keller and Gregory Frost, entitled "In Vivo Temporal Control of Activatable Matrix-Degrading Enzymes," filed Mar. 6, 2008, and to U.S. Provisional Application Ser. No. 61/127,725, to Gilbert Keller and Gregory Frost, entitled "In Vivo Temporal Control of Activatable Matrix-Degrading Enzyme," filed May 14, 2008. The subject matter of the above-noted applications are incorporated by reference in its entirety.

This application is related to International Application No. PCT/US2009/001486, entitled "In Vivo Temporal Control of Activatable Matrix-Degrading Enzymes," which claims priority to U.S. Provisional Application Ser. No. 61/068,667 and to U.S. Provisional Application Ser. No. 61/127,725. This application also is related to U.S. Provisional Patent Application Ser. No. 61/209,366, entitled "Temperature Sensitive Mutants of Matrix Metalloproteases and Uses Thereof." The subject matter of the above-noted related applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy # 1 Replacement Aug. 21, 2009 and Copy # 2 Replacement Aug 21, 2009), the contents of which are incorporated by reference in their entirety. The computer-readable file on each of the aforementioned compact discs, created on Aug. 21, 2009, is identical, 1.96 megabytes in size, and titled 3056SEQ.003.txt. A substitute Sequence Listing, incorporated by reference in its entirety, is provided on identical compact discs (labeled Copy # 1 Replacement Apr. 27, 2012, Copy # 2 Replacement Apr. 27, 2012, and Computer-Readable Form Replacement (CRF)), each compact disc containing the file 3056SEQ.004.txt, created on Apr. 27, 2012, and 1.96 megabytes in size.

FIELD OF THE INVENTION

Methods and combinations are provided for controlling the duration of action, in vivo, of matrix-degrading enzymes. The methods and combinations permit temporary in vivo activation of matrix-degrading enzymes upon administration to the extra cellular matrix (or "ECM"). Matrix-degrading enzymes having a controlled duration of action can be used to treat ECM-mediated diseases or disorders characterized by increased deposition or accumulation of one or more ECM components.

BACKGROUND

The extracellular matrix (ECM) provides a critical structural support for cells and tissues. Defects or changes in the extracellular matrix as a result of excessive deposition or accumulation of ECM components can lead to ECM-mediated diseases or conditions. Among these are collagen-mediated diseases or conditions characterized by the presence of abundant fibrous septae of collagen. Often the only approved treatment for such diseases or conditions is surgery, which can be highly invasive. Other treatments, such as needle aponeurotomy for the treatment of Dupuytren's syndrome (also called Dupuytren's contracture) or liposuction for cellulite, also are highly invasive.

Collagenase, an enzyme active at neutral pH that degrades collagen, has been used to treat ECM-mediated conditions such as cellulite (see e.g., published U.S. application serial No. US20070224184); Dupuytren's syndrome (see e.g. U.S. Patent No. USRE 39941; U.S. Pat. Nos. 5,589,171; 6,086,872); and Peyronie's disease (see e.g., U.S. Pat. No. 6,022,539). Collagenase, however, is capable of irreversibly cleaving collagens of type I, II and III. The prolonged activity of collagenase limits the dosages that can be administered and also risks side effects associated with prolonged activation. Hence, there is a need for alternative treatments of ECM-mediated diseases and conditions. Accordingly, it is among the objects herein to provide methods and combinations of activatable matrix-degrading enzymes for the treatment of ECM-mediated diseases and conditions.

SUMMARY

Provided are methods for treating diseases or conditions of the extracellular matrix (ECM) by administering an activatable matrix-degrading enzyme (AMDE) and an activator. Generally a therapeutically effective amount of the AMDE is administered. The amount is a function of the disease or condition treated and can be empirically determined. The AMDE that is selected is one that is inactive in the in vivo locus of administration, such as the ECM. AMDEs include naturally-occurring matrix-degrading (MD) enzymes, species and allelic and other variants thereof, such as enzymes modified to alter an activity, such as substrate specificity or property, such as stability. The AMDEs can be modified by processes and methods to have properties, such as increased specificity for a cleaving a particular type of collagen or to have an altered pH curve or optimum for the methods herein. Administration in conjunction with an activator or combination of activators, not present in the locus of administration results in an AMDE that is active for a limited period of time as the activator dissipates or is otherwise removed from the locus. The AMDE and activator can be administered sequentially, simultaneously in the same or separate composition, or intermittently. Conditions can be selected so that the period of time of activity is predetermined. An AMDE can require more than one activator for activity or full activity. The AMDE can be administered as a zymogen, as a full-length mature polypeptide, such as a single-chain or two-chain polypeptide, or as precursor polypeptide. The AMDE can be provided in a composition, such as a solution or suspension, or in crystallized or lyophilized form. Exemplary AMDEs include, but are not limited to, cathepsins, calpains and heparanases.

Generally, the AMDE is administered sub-epidermally. When administered to other loci, including topically, the AMDE is selected so that the AMDE is substantially active (typically at least about or 10%, 11%, 12%, 13% or 15% of the activity compared to at its pH maximum remains) at pH 5.5. In addition, for such administration, the AMDE typically is inactive (less than about or 10%, 11%, 12%, 13% or 15% of the activity remains) at neutral pH. Diseases and conditions of the ECM, include for example, collagen-mediated diseases and conditions. Such diseases and conditions include, but are not limited to: cellulite; Dupuytren's disease surgical adhesions, keloids, hypertrophic scars and depressed scars; Peyronie's disease; Ledderhose fibrosis; stiff joints; including a frozen shoulder; existing scars, including surgical adhesions, keloids, hypertrophic scars and depressed scars; scleroderma; lymphedema and collagenous colitis. Sub-epidermal administration includes, but is not limited to subcutaneous administration, intramuscular administration, intralesional administration and intradermal administration.

Thus, provided are methods for treating a disease or condition of the extracellular matrix (ECM) by sub-epidermally administering to the ECM an activatable matrix-degrading enzyme (AMDE) and an activator. The AMDE is inactive or partially inactive in the ECM in the absence of the activator; the activator, when administered to the ECM, provides an activating condition for the enzyme whereby the AMDE is active, and the activating condition is generally not present in the ECM prior to administration of the activator. In some embodiments the AMDE is selected to be an enzyme that is substantially inactive at neutral pH.

Also provided are methods of treating a disease or condition of the extracellular matrix (ECM) by administering an activatable matrix-degrading enzyme (AMDE) and an activator, wherein the AMDE is inactive at neutral pH, the activator provides an acidic pH activating condition for the enzyme such that the AMDE is active upon or after administration, and the activating condition is not present at the site of administration prior to administration of the activator; and the AMDE is substantially active at pH 5.5. The AMDE and activator can be administered by any suitable route, including, but not limited to, subcutaneous, intramuscular, intralesional, intradermal, topical, transdermal, intravenous, oral and rectal administration. For example, administration can be sub-epidermal administration.

Also provided are methods for treating a disease or condition of the extracellular matrix (ECM) by administering an activatable matrix-degrading enzyme (AMDE) and an activator, where the AMDE is inactive in the ECM in the absence of the activator such that the activator, when administered, provides an activating condition for the enzyme such that the AMDE is active, the activating condition is not present in the ECM prior to administration of the activator, and the activator is selected from among a metal ion, temperature and ionic strength of excipient, or a reducing or oxidizing agent. The AMDE and activator or combination of activators can be administered by any suitable route, including, but not limited to, subcutaneous, intramuscular, intralesional, intradermal, topical, transdermal, intravenous, oral and rectal administration. For example, administration can be sub-epidermal administration.

In an exemplary embodiment, provided are methods for treating a disease or condition of the extracellular matrix (ECM) by administering to the ECM an activatable matrix-degrading enzyme (AMDE) and an activator, where the AMDE is inactive in the ECM in the absence of the activator such that the activator, when administered to the ECM, provides an activating condition for the enzyme such that the AMDE is active, the activating condition is not present in the ECM prior to administration of the activator; and the activator is selected from among metal ions, temperature and ionic strength. The AMDE and activator can be administered by any suitable route, including, but are not limited to, subcutaneous, intramuscular, intralesional, intradermal, topical, transdermal, intravenous, oral and rectal administration. For example, administration can be sub-epidermal administration.

In other exemplary embodiments provided are methods for treating a collagen-mediated disease or condition by sub-epidermally administering to the ECM a therapeutically effective amount of an activatable cathepsin L and an activator, where the activatable cathepsin L is inactive in the ECM in the absence of the activator, the activator, when administered to the ECM, provides an activating condition for the enzyme such that the activatable cathepsin L is active, the activating condition is not present in the ECM prior to administration of the activator; and the activating condition is acidic pH. Exemplary cathepsin L polypeptides are those that include a sequence of amino acids set forth in SEQ ID NO:1 or allelic, species or other variant thereof, where such variants are modified to have altered properties or activities and, typically have at least or have 60%, 65%, 70%, 75%, 80%, 85%, 90%, 91%, 92%, 93%, 94%, 95%, 96%, 97%, 98% or 99% sequence identity compared to a sequence of amino acids set forth in any of SEQ ID NO:1.

In general over time in the methods herein, the activator will be removed or dissipated or neutralized by the local environment so that the AMDE is no longer active. Activating conditions and/or activators can be selected or prepared so that the AMDE is active for a limited or predetermined time. The activator can be provided or administered in the same composition as the AMDE or in a separate composition, and they can be administered sequentially, simultaneously or intermittently. For example, the AMDE is exposed to the activator prior to administration or upon administration, whereby the enzyme is active upon administration. Activating conditions include, but are not limited to, pH, ionic strength, temperature and metal ions. Among the activating conditions is pH, such as acidic pH, for example at or about in a range of 3 to 6.5, or 3.5 to 6, or 3 to 5.5, or 3 to 4.5, or 4 to 6, or 4 to 5.5, or 4.5 to 5, or 5 to 6, such as 3, 3.5, 4, 4.5, 5, 5.5, 6 or 6.5. pH can be obtained by contacting the AMDE with a buffered solution at the desired pH. Buffers can include those that contain an acid selected from among 2-(N-morpholino)ethanesulfonic acid (MES), acetic acid, citric acid, maleate, lactate, glycinate, citric phosphate and histidine. Other exemplary activity conditions include, but are not limited to, metal ions and temperature. For example, the activating condition can be a metal ion, such as $Ca^{2+}$, $Zn^{2+}$ or $Mg^{2+}$. Temperature can be low or high temperature, where the enzyme is substantially inactive at the temperature of the locus of administration, typically 37° C. Thus, the activating condition is temperature and the temperature is or is about 20° C., 21° C., 22° C., 23° C., 24° C., 25° C., 26° C., 27° C., 28° C., 29° C., 30° C. or above 37° C., such as 40° C., 41° C., 42° C., 43° C., 44° C., 45° C., 46° C., 47° C., 48° C., 49° C., 50° C., 55° C., 60° C., 65° C., 70° C., 80° C. and higher up to any temperature tolerated that does not damage in vivo tissues or cells.

Temporal control of the activity can be achieved, for example, by selection of the buffering capacity of the buffer and/or ionic strength thereof. A predetermined time for activity can be effected by selection of such conditions, which can be determined empirically or by any method known to one of skill in the art. Predetermined times can range from less than or about a minute to hours, such as about or 1 minute, 2 minutes, 3 minutes, 4 minutes, 5 minutes, 6 minutes, 7 minutes, 8 minutes, 9 minutes, 10 minutes, 20 minutes, 30 minutes, 40 minutes, 50 minutes, 1 hour, 2 hours, 3 hours and 4 hours.

As noted an AMDE can be any matrix degrading enzyme that is activatable or that is modified so that it is activatable by a particular activator or activation condition. Among the AMDEs for use in the methods herein are lysosomal enzymes. AMDEs include, for example, cathepsins, such as cathepsins that are cysteine or aspartic proteases. These include, for example, cathepsin S, cathepsin K, cathepsin L, cathepsin B, cathepsin C, cathepsin H, cathepsin F, cathepsin O, cathepsin R, cathepsin V, cathepsin W, cathepsin D and cathepsin E. Exemplary of such cathepsins are any selected from a cathepsin that has a sequence of amino acids set forth in any of SEQ ID NOS: 57, 60, 1, 65, 180, 68, 71, 74, 77, 183, 186, 189, 80, 195, 90, 93 and 96, or an allelic, or species variant or other variant of any of SEQ ID NOS: 57, 60, 1, 65, 180, 68, 71, 74, 77, 183, 186, 189, 80, 195, 90, 93 and 96. Other variants, include, for example, enzymes modified to have an altered property, such as stability, or activity, such as substrate specificity. Variants can have, for example, 60%, 65%, 70%, 75%, 80%, 85%, 90%, 91%, 92%, 93%, 94%, 95%, 96%, 97%, 98%, 99% more sequence identity with any of the polypeptides whose sequence of amino acids is set forth in any of SEQ ID NOS: 57, 60, 1, 65, 180, 68, 71, 74, 77, 183, 186, 189, 80, 195, 90, 93 and 96.

In the methods herein, the AMDE, upon administration, can cleave any one or more extracellular matrix (ECM) components. Such cleavage occurs for a limited time, which can be predetermined. ECM components that are cleaved, include, but are not limited to, for example, collagens, elastins, fibronectins and proteoglycans, such as a type I, type II, type III or type IV collagen. The AMDEs can be modified, such as by directed evolution methods or other methods, to have altered properties or activities, such as increased substrate specificity for type I collagen over type IV collagen.

Other agents can be administered with the activator and enzymes. Administration can be in the same composition as the activator and/or enzyme or as separate compositions. Administration can be performed simultaneously, separately or intermittently. Exemplary agents, include, but are not limited to, for example, pharmacologic agents selected from among other biologics, small molecule compounds, dispersing agents, anesthetics and vasoconstrictors and/or combinations thereof. Exemplary of a dispersing agent is a hyaluronan degrading enzyme, for example a hyaluronidase, such as PH20, such as a soluble form thereof, particularly rHuPH20, Such a hyaluronidase typically is administered prior to administration of the enzyme and activator. Exemplary of a soluble hyaluronidase is the product designated rHuPH20, which is encoded by nucleic acid the encodes a polypeptide that has a sequence of amino acids set forth in SEQ ID NO:226, or is an allelic or species variant or other variant thereof or a variant of such polypeptide that has at least about 60%, 65%, 70%, 75%, 80%, 85%, 90%, 95%, 96%, 97%, 98%, 99% or more sequence identity to the sequence of amino acids set forth in SEQ ID NO:226.

Other agents include anesthetics, such as lidocaine, and vasoconstrictors, such as alpha adrenergic receptor agonists, including, for example, levonordefrin, epinephrine and norepinephrine. Typically such agents are administered with or before the AMDE and activator. Thus, provided are methods of treating a disease or condition of the extracellular matrix (ECM) by sub-epidermally administering an activatable matrix-degrading enzyme (AMDE), as described above, an activator, a hyaluronidase, lidocaine and epinephrine. The AMDE is inactive in the ECM in the absence of the activator. The enzyme, hyaluronidase, lidocaine and epinephrine can be administered simultaneously, sequentially or intermittently, provided that the lidocaine is administered prior to the enzyme. For example, the hyaluronidase, lidocaine and epinephrine are administered prior to administration of the enzyme or the hyaluronidase, lidocaine and epinephrine are administered simultaneously or the hyaluronidase, lidocaine and epinephrine can be administered in a single composition. The AMDE and activator and other agents can be administered by any suitable route, including, but not limited to, subcutaneous, intramuscular, intralesional, intradermal, topical, transdermal, intravenous, oral and rectal administration. For example, administration can be sub-epidermal administration.

Also provided are products, including compositions, containers, combinations and kits that can be used to effect the methods. For example, provided are containers that contain two compartments. A first compartment contains a therapeutically effective amount of an activatable matrix-degrading enzyme (AMDE), where the amount is for single dosage or a plurality of dosages and a single dosage is effective for treatment of a disease or condition of the ECM ; and a second compartment contains an activator, where the activator is one that activates the enzyme. AMDEs include, for example lysosomal enzymes, such as cathepsins, calpains and heparanases, including those described above for use in the methods. The AMDEs in the containers are those as described above, including, for example, an AMDE that is substantially active at pH 5.5, and, optionally is substantially inactive at neutral pH. The activators provide for activating conditions such as those described above. Hence the second compartment can contain a composition that effects a change or maintains a pH, such as a buffer, or ionic strength or provides a metal ion, such as $Ca^{2+}$, $Zn^{2+}$, $Mg^{2+}$. Exemplary buffers include those that contain acids from among 2-(N-morpholino)ethanesulfonic acid (MES), acetic acid, citric acid, maleate, succinate, lactate, glycinate, citric phosphate and histidine. The diseases and conditions, include those described above. The containers can also include a mixing compartment to effect mixing of the components in the first and second compartments. Exemplary containers, include tubes and bottles, sterile contains, such a syringe, with or without a needle for injection.

The AMDE and activator are provided in an amount for single or multiple dosage administration. The AMDE in the container can be provided in an amount that is or is about 10 µg to 100 mg, 50 µg to 75 mg, 100 µg to 50 mg, 250 µg to 25 mg, 500 µg to 10 mg, 1 mg to 5 mg, or 2 mg to 4 mg. It can be provided as a solid, such as in crystallized form or lyophilized form, or in liquid form, such as solution or suspension, a gel or other suitable form. The total volume of liquid in the container, for example, can be or is about 1-100 ml, 1-50 ml, 10-50 ml, 10-30 ml, 1-20 ml, and 1-10 ml.

In an exemplary embodiment provided are containers that have at least two compartments, where a first compartment contains a therapeutically effective amount of an activatable cathepsin L and the amount is effective for treatment of a disease or condition of the extracellular matrix (ECM); and a second compartment contains an acidic buffer that is one that activates the cathepsin L. The diseases and conditions are those described above for the method of treatment. The activator can be pH that is provided by a buffer, particularly an acidic buffer has a range that is or is about pH 4.0-5.0, particularly 4.5 to 6, more particularly, 4.0, 4.5, 5, 5.5 or 6. Exemplary buffers are among acidic buffers that contain an acid, such as, 2-(N-morpholino)ethanesulfonic acid (MES), acetic acid, citric acid, succinic acid, lactic acid, maleic acid, glycine-hydrochloric acid, citric phosphate and histidine. Exemplary cathepsin L polypeptides are those that include a sequence of amino acids set forth in SEQ ID NO:1 or allelic, species or other variant thereof, where such variants are modified to have altered properties or activities and, typically have at least or have 60%, 65%, 70%, 75%, 80%, 85%, 90%, 91%, 92%, 93%, 94%, 95%, 96%, 97%, 98% or 99% sequence identity compared to a sequence of amino acids set forth in any of SEQ ID NO:1. The activatable cathepsin L can be provided as a lyophilized powder, particularly of an activated mature form that is two-chain or single-chain form. The amount of activatable cathepsin L in the container is therapeutically effective for the particular disease or condition, and can range, for example, from about or: 10 µg to 100 mg, 50 µg to 75 mg, 100 µg to 50 mg, 250 µg to 25 mg, 500 µg to 10 mg, 1 mg to 5 mg and 2 mg to 4 mg. The particular amount can depend on the particular disease or condition, and, if necessary, can be empirically determined. The cathepsin L can be provided as a solid, such as a lyophilized powder, a paste or liquid, such as a suspension, dispersion, or solution. The volume in the container is suitable for the amount of cathepsin L and the intended route and/or locus of administration. For example, a typical volume in the container is or is about 1-100 ml, 1-50 ml, 10-50 ml, 10-30 ml, 1-20 ml, or 1-10 ml.

Also provided are combinations that include the above-described container(s) and one or more additional containers containing another pharmacologically effective agent. Such agents can be selected from among biologics, small molecule compounds, dispersing agents, anesthetics and vasoconstrictors and combinations thereof. These agents include the agents and amounts as described above with reference to the methods. For example, an additional container can contain a hyaluronidase, such as rHuPH20. The amount can be for example from about/or: 10 Units to 500,000 Units, 100 Units to 100,000 Units, 500 Units to 50,000 Units, 1000 Units to 10,000 Units, 5000 Units to 7500 Units, 5000 Units to 50,000 Units, or 1,000 Units to 10,000 Units. Other containers can contain anesthetics, such as lidocaine, in an amount, for example of at or about 10 mg to 1000 mg, 100 mg to 500 mg, 200 mg to 400 mg, 20 mg to 60 mg, or 30 mg to 50 mg, and/or a vasoconstrictor, such as an alpha adrenergic receptor agonist, including levonordefrin, epinephrine or norepinephrine in an amount to effect vasoconstriction at the locus and region of administration. The amount, for example, can be at or about 10 µg to 5 mg, 50 µg to 1 mg, 50 µg to 500 µg, 50 µg to 250 µg, 100 µg to 500 µg, 200 µg to 400 µg, 1 mg to 5 mg or 2 mg to 4 mg of, for example, epinephrine or other vasoconstrictor. Each of the additional pharmacologically effective agents can be mixed in any combination in one container or can be provided in single containers. They can be provided as liquids or solids as exemplified and described above for cathepsin L.

In exemplary embodiments, the combinations, can contain the AMDE and activator, and the container can contain at least two pharmacologically effect agents, where the pharmacologic agents are provided as separate compositions separated from each other or are provided in the same container in the same composition. For example, the additional container can contain one or more of a hyaluronidase, lidocaine and epinephrine. The additional container can be in the form of a syringe with or without a needle. The total volume in the additional container(s) is or is about 1-100 ml, 1-50 ml, 10-50 ml, 10-30 ml, 1-20 ml, or 1-10 ml.

In exemplary embodiments, the combination includes cathepsin L and the hyaluronidase, such as rHuPH20. They can be provided as separate compositions or are in a single composition in one container. The combination can include an acidic buffer that activates the cathepsin L. The buffer can be provided in a separate container or mixed with one or both of the cathepsin L and hyaluronidase. Also provided are pharmaceutical compositions that contain an amount of cathepsin L effective for treatment of an ECM-mediated disease or condition upon administration simultaneously or sequentially with an acidic buffer, where the composition is formulated for single dosage administration; and the buffer has a pH that activates cathepsin L. The amount of cathepsin L is effective for the particular disease or condition, and for example, is or is about 10 µg to 100 mg, 50 µg to 75 mg, 100 µg to 50 mg, 250 µg to 25 mg, 500 µg to 10 mg, 1 mg to 5 mg, or 2 mg to 4 mg. The composition can further contain one or more of lidocaine, epinephrine and a hyaluronidase.

The containers and/or combinations and compositions can be packaged as kits. The kits contain the containers and/or combinations and optionally additional reagents for use in the methods provided herein, devices for administration, such as vials, tubes, syringes and needles, provided herein and/or instructions for such use.

BRIEF DESCRIPTION OF THE FIGURES

FIGS. 1A-G: FIGS. 1A-G are an alignment of zymogen MMPs, indicating the propeptide, the catalytic domain, linker region, hemopexin domains 1-4, fibronectin type II repeats, the basic region, the cysteine switch, the calcium (Ca) binding sites I and II, and the zinc binding site. The alignment includes zymogen MMPs, including MMP-1 (SEQ ID NO:327), MMP-8 (amino acids 21-467 of SEQ ID NO:101), MMP-13 (amino acids 20-471 of SEQ ID NO:104), MMP-18 (amino acids 18-467 of SEQ ID NO:107), MMP-2 (amino acids 30-660 of SEQ ID NO:110), MMP-9 (amino acids 20-707 of SEQ ID NO:113), MMP-3 (amino acids 18-477 of SEQ ID NO:116), MMP-10 (amino acids 18-476 of SEQ ID NO:119), MMP-11 (amino acids 32-488 of SEQ ID NO:122), MMP-7 (amino acids 18-267 of SEQ ID NO:125), MMP-26 (amino acids 18-261 of SEQ ID NO:128), MMP-12 (amino acids 17-470 of SEQ ID NO:131), and MMP-19 (amino acids 19-508 of SEQ ID NO:146). A "*" means that the residues or nucleotides in that column are identical in all sequences in the alignment, a ":" means that conserved substitutions have been observed, and a "." means that semi-conserved substitutions are observed.

FIGS. 2A-D: FIGS. 2A-D are an alignment of the catalytic domains of exemplary MMPs, indicating exemplary conserved and conservative amino acid residues. It is understood that other conserved and conservative amino acid residues exist between and among MMPs. Thus, these figures and identification of residues is not intended to limit corresponding residues between and among MMPs. The exemplary MMPs include: MMP-1 (amino acids 81-242 of SEQ ID NO:327), MMP-8 (amino acids 101-242 of SEQ ID NO:101), MMP-13 (amino acids 104-248 of SEQ ID NO:104), MMP-18 (amino acids 100-246 of SEQ ID NO:107), MMP-2 (amino acids 110-417 of SEQ ID NO:110), MMP-9 (amino acids 94-425 of SEQ ID NO:113), MMP-3 (amino acids100-247 of SEQ ID NO:116), MMP-10 (amino acids 99-246 of SEQ ID NO:119), MMP-11 (amino acids 98-228 of SEQ ID NO:122), MMP-7 (amino acids 95-242 of SEQ ID NO:125), MMP-26 (amino acids 90-236 of SEQ ID NO:128), MMP-12 (amino acids 106-247 of SEQ ID NO:131), and MMP-19 (amino acids 98-239 of SEQ ID NO:146). Exemplary conserved and conservative substitutions are highlighted.

DETAILED DESCRIPTION

Outline

Figure 1A:

A. Definitions
B. The Extracellular Matrix
   1. Components of the ECM
      a. Collagens
      b. Elastin
      c. Fibronectin
      d. Glycosaminoglycans (GAGs)
         i. Proteoglycans
         ii. Hyaluronic Acid
   2. Histology of the Skin
      a. The Epidermis
      b. The Dermis
      c. The Hypodermis
   3. Diseases of the ECM
C. Matrix-Degrading Enzymes
   1. Enzyme Activation
      a. Serine Proteases
      b. Cysteine Proteases
         i. Cathepsins
            Cathepsin L
         ii. Calpain
      c. Aspartic Proteases
      d. Metalloproteases
      e. Heparanase
D. Activatable Matrix-Degrading Enzymes (AMDE)
   1. Activating Conditions and Methods for Activation of Activatable Matrix-Degrading Enzymes
      a. Activating Condition - Acidic pH
      b. Activating Condition - Metal Cation Concentration
      c. Activating Condition - Reducing Agent
      d. Activating Condition - Temperature
         i. Temperature-Sensitive Matrix Metalloprotease Mutants
            1) Exemplary tsMMP-1 Modifications
            2) Combinations
            3) Additional Modifications
            4) Other MMPs
   2. Combinations of Matrix-Degrading Enzymes and Activator
E. Methods of Producing Nucleic Acids Encoding Matrix-Degrading Enzymes, and Polypeptides Thereof
   1. Vectors and Cells
   2. Expression
      a. Prokaryotic Cells
      b. Yeast Cells
      c. Insect Cells
      d. Mammalian Cells
      e. Plants
   3. Purification Techniques
F. Preparation, Formulation and Administration of Activatable Matrix-Degrading Enzymes
   1. Injectables, solutions and emulsions
      Lyophilized Powders
   2. Topical Administration
   3. Compositions for other routes of administration
   4. Combination Therapies
      a. Hyaluronan Degrading Enzymes
         i. Hyaluronidases
            1) Mammalian-type hyaluronidases
            2) Bacterial Hyaluronidases
            3) Hyaluronidases from leeches, other parasites and crustaceans
         ii. Other hyaluronan degrading enzymes
         iii. Soluble hyaluronan degrading enzymes
            1) Soluble Human PH20
            2) rHuPH20
         iv. Modifications of hyaluronan degrading enzymes to improve their pharmacokinetic properties
G. Packaging and Articles of Manufacture of Activatable Matrix-Degrading Enzymes
   1. Single Chamber Apparatus
   2. Dual Chamber Apparatus
   3. Kits
H. Methods of Assessing Activity of Matrix-Degrading Enzymes
   1. Methods of Assessing Enzymatic Activity
   2. Methods of Assessing ECM Degradation
      a. In vitro assays
      b. In vivo assays
      c. Non-human animal models
I. Exemplary Methods of Treating Diseases or Defects of ECM Collagen-Mediated Diseases or Conditions
   a. Cellulite
   b. Dupuytren's Disease
   c. Peyronie's Disease
   d. Ledderhose Fibrosis
   e. Stiff Joints
   f. Existing Scars
      i. Surgical Adhesions
      ii. Keloids
      iii. Hypertrophic scars
      iv. Depressed Scars
   g. Scleroderma
   h. Lymphedema
   i. Collagenous colitis
J. Examples

A. Definitions

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, the extracellular matrix (ECM) refers to a complex meshwork structure that surrounds and provides structural support to cells of specialized tissues and organs. The ECM is made up of structural proteins such as collagen and elastin; specialized proteins such as fibronectin; and proteoglycans. The exact biochemical composition varies from tissue to tissue. In the skin, for example, it is the dermal layer that contains the ECM. Reference to the "interstitium" is used interchangeably herein to refer to the ECM.

As used herein, components of the ECM refers to any material produced by cells of connective tissue and secreted into the interstitium. For purposes herein, references to ECM components refers to proteins and glycoproteins, and not to other cellular components or other components of the ECM. Exemplary ECM components include, but are not limited to, collagen, fibronectin, elastin and proteoglycans.

As used herein, a matrix degrading enzyme refers to any enzyme that degrades one or more components of the ECM. Matrix-degrading enzymes include protease, which are enzymes that catalyze the hydrolysis of covalent peptidic bonds. Matrix-degrading enzymes include any known to one of skill in the art, such as any described herein (see, e.g., Table 3), allelic or species variants or other variants thereof.

Figure 1D:
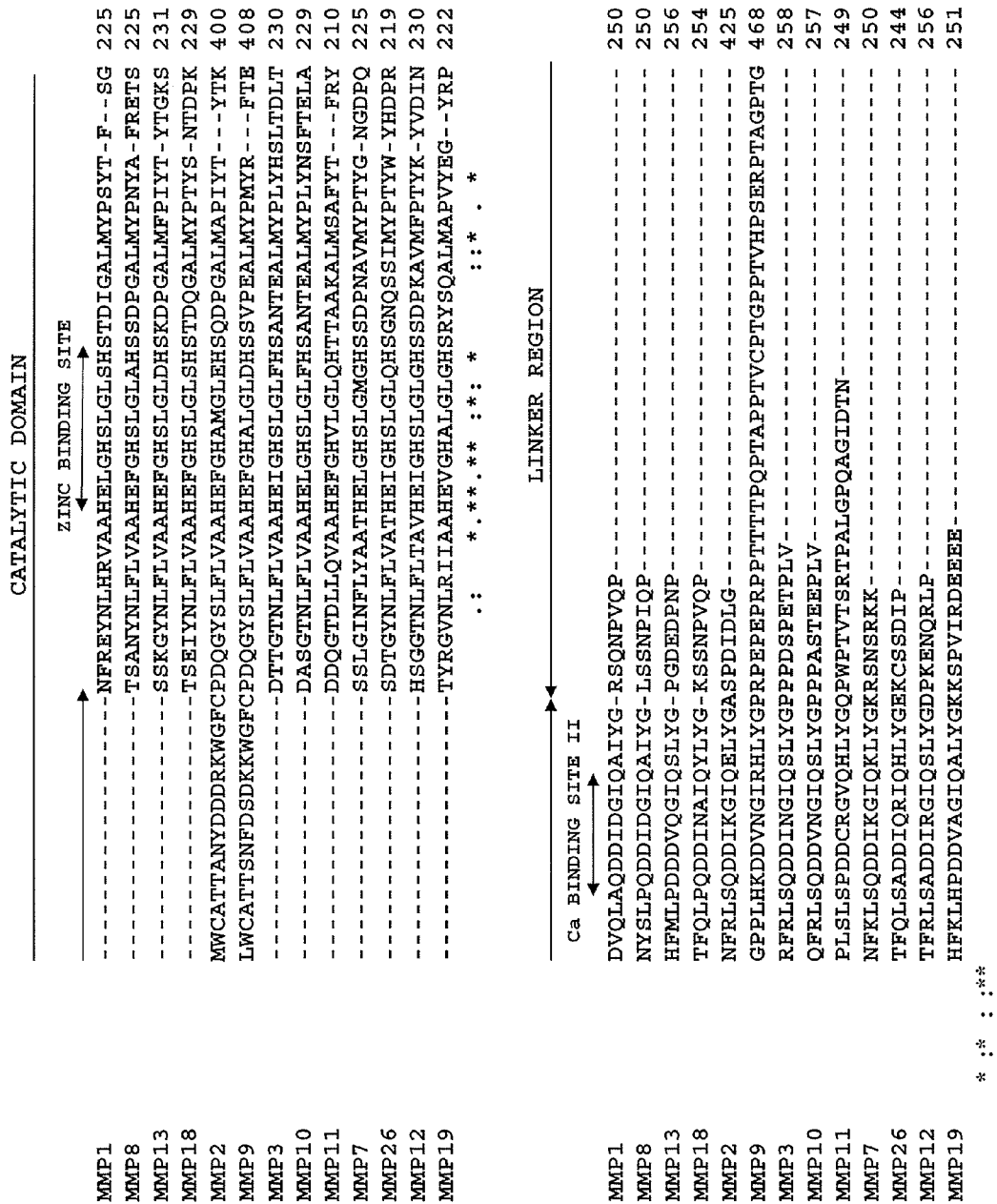

As used herein, a matrix metalloprotease (MMP) refers to a type of matrix degrading enzyme that are zinc-dependent endopeptidases that contain an active site $Zn^{2+}$ required for activity. MMPs include enzymes that degrade components of the ECM including, but not limited to, collagen, fibronectin, elastin and proteoglycans. MMPs generally contain a propeptide, a catalytic domain, a proline linker and a hemopexin (also called haemopexin-like C-terminal) domain. Some MMPs contain additional domains. Exemplary MMPs are set forth in Table 5. Reference to an MMP includes all forms, for example, the precursor form (containing the signal sequence), the proenzyme form (containing the propeptide), the processed active form, and fauns thereof lacking one or more domains. For example, reference to an MMP refers to MMPs containing only the catalytically active domain. Domains of exemplary MMPs are identified in FIGS. 1A-G. MMPs also include allelic or species variants or other variants thereof.

As used herein, a modified matrix-degrading enzyme (or variant of a matrix-degrading enzyme) refers to an enzyme that has one or more modifications in primary sequence compared to a wild-type enzyme. The one or more mutations can be one or more amino acid replacements (substitutions), insertions, deletions and any combination thereof. A modified enzyme includes those with 1, 2, 3, 4, 5, 6, 7, 8, 9, 10, 11, 12, 13, 14, 15, 16, 17, 18, 19, 20 or more modified positions. A modified enzyme retains the activity of a wild-type enzyme, but may have altered substrate specificity or stability. A modified enzyme typically has 60%, 70%, 80%, 85%, 90%, 91%, 92%, 93%, 94%, 95%, 96%, 97%, 98%, 99% or more sequence identity to a corresponding sequence of amino acids of a wildtype enzyme.

As used herein, a lysosomal enzyme refers to enzymes whose degradative function is optimal at acidic pH. By virtue of the requirement of low pH, such enzymes generally are present in the lysosomes of cells. Lysosomal enzymes include, but are not limited to, cathepsin S, K, L B, C, H, F, O, R, V, D and E. Exemplary of lysosomal enzymes include precursor forms set forth in any of SEQ ID NOS:56, 59, 62, 64, 179, 67, 70, 73, 76, 182, 185, 188, 79, 194, 89, 92 and 95 and mature forms thereof set forth in SEQ ID NOS:57, 60, 1, 65, 180, 68, 71, 74, 77, 183, 186, 189, 80, 195, 90, 93 and 96 or allelic variants or species variants or other variants thereof. Other lysosomal enzymes include, but are not limited to, lysosomal acid lipase, gastric lipase, lysosomal phospholipase and bile salt-activated lipase (nucleic acid sequences encoding amino acids sequences, including mature forms thereof, are set forth in any of SEQ ID NOS: 196-207).

As used herein, a temperature sensitive (ts) mutant or mutation or variant or modification conferring temperature sensitivity refers to a polypeptide that is modified to exhibit higher enzymatic activity at some temperatures called permissive temperatures compared to other temperatures called nonpermissive temperatures. Generally, a temperature-sensitive mutant exhibits higher enzymatic activity at lower temperatures then at higher temperatures.

As used herein, permissive temperature is the temperature at which a polypeptide exhibits a higher enzymatic activity then at a second temperature called the nonpermissive temperature. Hence, the modified enzymes provided herein exhibit different activities at different temperatures that is higher at one temperature then at another temperature. The temperature at which it exhibits more activity is the permissive temperature.

As used herein, a nonpermissive temperature is the temperature where a polypeptide exhibits lower enzymatic activity then at the permissive temperature and exhibits reduced activity compared to the enzyme that is not modified. Temperature-sensitive mutants provided herein exhibit enzymatic activity at the nonpermissive temperature that is at or about 1%, 2%, 3%, 4%, 5%, 6%, 7%, 8%, 9%, 10%, 20%, 30%, 40%, 50%, 60%, 70%, 80% or 90% up to less then 100% the activity at the permissive temperature. The temperature sensitive mutants provided herein also exhibit 1%, 2%, 3%, 4%, 5%, 6%, 7%, 8%, 9%, 10%, 20%, 30%, 40%, 50%, 60%, 70%, 80% or 90% up to less then 100% of the activity at the nonpermissive temperature compared to the enzyme that is not modified (e.g. wildtype enzyme) at the nonpermissive temperature.

As used herein, the ratio of enzymatic activity at the permissive temperature compared to the nonpermissive temperature refers to the relation of enzymatic activity at the permissive and nonpermissive temperatures. It is expressed by the quotient of the division of the activity at the permissive temperature by the activity at the nonpermissive temperature.

As used herein, physiological temperature refers to temperature conditions maintained in the body, which is approximately 37° C., for example, at or about 34° C., 35° C., 36° C., 37°, 38° C. or 39° C. It is understood that the normal range of a human body temperature varies depending on factors such as the rate of metabolism, the particular organ and other factors. For purposes herein, physiological temperature is the temperature that exists for a non-fasting, comfortably dressed subject that is indoors in a room that is kept at a normal room temperature (e.g. 22.7 to 24.4° C.).

As used herein, reversible refers to a modified enzyme whose activity at the permissive temperature is capable of being recovered or partially recovered upon exposure to the nonpermissive temperature and reexposure to the permissive temperature. Hence, the activity of a reversible enzyme once it is exposed to the nonpermissive temperature is the same or substantially retained compared to the activity of the enzyme exposed only to the permissive conditions and is greater then the activity of the enzyme exposed only to the nonpermissive temperature. For example, upon return to permissive conditions from nonpermissive conditions, reversible enzymes exhibit at or about 120%, 125%, 130%, 140%, 150%, 160%, 170%, 180%, 200% or more the activity of the enzyme exposed only to the nonpermissive temperatures and retain the activity of the enzyme exposed only to the permissive temperature.

As used herein, irreversible or nonreversible refers to a modified enzyme whose enzymatic activity at the permissive temperature is not recovered upon exposure to the nonpermissive temperature and reexposure to the permissive temperature. Hence, the activity of an irreversible enzyme once it is exposed to the nonpermissive temperature is less then the activity of the enzyme exposed only to the permissive temperature and also is less then or the same or substantially the same as the activity of the enzyme exposed only to the nonpermissive conditions. For example, upon return to permissive conditions, irreversible enzymes exhibit at or about 20%, 30%, 40%, 50%, 60%, 70%, 80%, 90%, 100%, 105%, 110%, 115%, or 120% the activity at nonpermissive temperatures and less then 100% of the activity at the activity of the enzyme exposed only to the permissive temperature.

As used herein, a domain refers to a portion (a sequence of three or more, generally 5 or 7 or more amino acids) of a polypeptide that is a structurally and/or functionally distinguishable or definable. For example, a domain includes those that can form an independently folded structure within a protein made up of one or more structural motifs (e.g. combinations of alpha helices and/or beta strands connected by loop regions) and/or that is recognized by virtue of a functional activity, such as kinase activity. A protein can have one, or more than one, distinct domain. For example, a domain can be identified, defined or distinguished by homology of the sequence therein to related family members, such as homology and motifs that define an extracellular domain. In another example, a domain can be distinguished by its function, such as by enzymatic activity, e.g. kinase activity, or an ability to interact with a biomolecule, such as DNA binding, ligand binding, and dimerization. A domain independently can exhibit a function or activity such that the domain independently or fused to another molecule can perfoitu an activity, such as, for example proteolytic activity or ligand binding. A domain can be a linear sequence of amino acids or a non-linear sequence of amino acids from the polypeptide. Many polypeptides contain a plurality of domains. For example, the domain structure of MMPs is set forth in FIGS. 1A-G. Those of skill in the art are familiar with domains and can identify them by virtue of structural and/or functional homology with other such domains.

As used herein, a catalytic domain refers to any part of a polypeptide that exhibits a catalytic or enzymatic function. Such domains or regions typically interact with a substrate to result in catalysis thereof. For MMPs, the catalytic domain contains a zinc binding motif, which contains the $Zn^{2+}$ion bound by three histidine residues and is represented by the conserved sequence HExxHxxGxxH (SEQ ID NO: 538).

As used herein, a proline rich linker (also called the hinge region) refers to a flexible hinge or linker region that has no determinable function. Such a region is typically is found between domains or regions and contributes to the flexibility of a polypeptide.

As used herein, a hemopexin binding domain or haemopexin-like C-terminal domain refers to the C-terminal region of MMP. It is a four bladed (β-propeller structure, which is involved in protein-protein interactions. For example, the hemopexin binding domain of MMPs interact with various substrates and also interact with inhibitors, for example, tissue inhibitor of metalloproteases (TIMPs).

As used herein, consisting essentially of or recitation that a polypeptide consists essentially of a particular domain, for example the catalytic domain means that the only MMP portion of the polypeptide is the domain or a catalytically active portion thereof. The polypeptide optionally can include additional non-MMP-derived sequences of amino acids, typically at least 3, 4, 5, 6 or more, such as by insertion into another polypeptide or linkage thereto.

As used herein, a "zymogen" refers to an enzyme that is an inactive precursor and requires some change, such as proteolysis of the polypeptide, to become active. Some zymogens also require the addition of cofactors such as, but not limited to, pH, ionic strength, metal ions or temperature for activation. Zymogens include the proenzyme form of enzymes. Hence, zymogens, generally, are inactive and can be converted to a mature polypeptide by catalytic or autocatalytic cleavage of the proregion from the zymogen in the presence or absence of additional cofactors.

As used herein, a prosegment or proregion refers to a region or a segment that is cleaved to produce a mature protein. This can include segments that function to suppress the enzymatic activity by masking the catalytic machinery. A proregion is a sequence of amino acids positioned at the amino terminus of a mature polypeptide and can be as little as a few amino acids or can be a multidomain structure.

As used herein, an activation sequence refers to a sequence of amino acids in a zymogen that are the site required for activation cleavage or maturation cleavage to form an active protease. Cleavage of an activation sequence can be catalyzed autocatalytically or by activating partners.

Activation cleavage is a type of maturation cleavage in which a conformational change required for activity occurs. Activation can result in production of multi-chain forms of the proteases, for example, two-chain forms. In some instances, single chain forms of the protease can exhibit proteolytic activity as a single chain.

As used herein, a cofactor refers to a condition or factor that is required for activity of an enzyme. Cofactors includes anything required for enzymatic activity. Examples of cofactors include, but are not limited to, pH, ionic strength, metal ions or temperature. With reference to in vivo administration of an enzyme, cofactors include endogenously present factors and exogenously provided factors.

As used herein, an activating condition refers to any physical condition or combination of conditions that is required for an enzyme's activity. For purposes herein, an activating condition for an activatable matrix-degrading enzyme (AMDE) includes those that are not present at the site of administration, for example, not present in the extracellular matrix, in amounts (i.e. quantity, degree, level or other physical measure) required for activation of the enzyme. Exemplary of activating conditions include, but are not limited to, pH, metal ions, reducing or oxidizing agents, temperature and ionic strength. For example, in the case of lysosomal matrix degrading-enzymes that are active at conditions of low pH but inactive at neutral pH, exposure of the inactive enzyme to an activating condition that is acidic pH results in activation of the enzyme. By virtue of the fact that the activating condition is not present at the site of administration of the enzyme, but must be added exogenously, the activating condition will dissipate and/or be neutralized over time, such that the activating condition is no longer present to activate the enzyme. Hence, the enzyme will be active for a limited or predetermined time upon administration.

As used herein, an activator refers to any composition that provides an activating condition for an activatable matrix-degrading enzyme. Examples of activators include, but are not limited to an acidic pH buffer, a cold buffer, or a calcium buffer.

As used herein, an "activatable matrix-degrading enzyme (AMDE)" refers to a matrix degrading enzyme that requires an activating condition in order to be active. For purposes herein, for example, an AMDE is substantially inactive in the ECM unless exposed to activators before, with or subsequent to administration of the AMDE, thereby providing an activating condition for the enzyme. Hence, activation of activatable enzymes is controlled by exogenous conditions so that the period of time at an in vivo locus or site during which the enzyme is active can be predetermined and/or controlled as a result of the dissipation and/or neutralization of the activation condition (i.e. temporally controllable or time-controlled). Thus, by virtue of exposure to an activating condition, the enzymes are active for a limited time and/or to a limited extent in the ECM (i.e. are conditionally active). The extent and time of activation can be controlled by selection of activator or activating conditions, and can be for a predetermined time. For example, a lysosomal enzyme, such as a cathepsin L, is activatable in that it can be activated by exposure to the activating condition of pH, such as provided by an acidic buffered solution. Upon administration of the activated enzyme to the neutral pH environment of the ECM, the pH environment will return to neutrality in a time period that can be predetermined based upon the buffering capacity of the acidic buffer, such that the enzyme will become inactive.

As used herein, "amount of an activator" refers to the quantity, degree or level of an activator. The amount of an activator can be a concentration or absolute amount, or a particular temperature or pH. For purposes herein, the amount of an activator is typically an amount that is sufficient to result in the conditional activation of an enzyme. The amount can be adjusted to alter the duration of activation so that activation can be for a limited or predetermined time.

As used herein, a "therapeutically effective amount" or a "therapeutically effective dose" refers to an agent, compound, material, or composition containing a compound that is at least sufficient to produce a therapeutic effect.

As used herein, an enzyme that is active for a limited time or for limited duration refers to an active enzyme having activity that dissipates and/or is neutralized over time. Thus, by virtue of the absence of an activation condition, the enzyme is rendered inactive.

As used herein, predetermined time means a limited that that is known before and can be controlled. The dissipation and/or neutralization of an activation condition required for an enzyme's activity can be titrated so that the time required for an active enzyme to become inactive is known. For example, an acid activated enzyme that is administered in acid medium and exposed to an in vivo environment having a neutral pH (i.e. the ECM) will, over time, be exposed to a gradually increased pH such that the enzyme will remain active for only a limited time. The rate of pH increase can be controlled, for example, by varying buffering capacity of the acidic buffer such that the period of time required for an active enzyme to become inactive can be pre-determined. For purposes herein, an enzyme can be active for a predetermined time that is or is about 1 minute, 2 minutes, 3 minutes, 4 minutes, 5 minutes, 6 minutes, 7 minutes, 8 minutes, 9 minutes, 10 minutes, 15 minutes, 20 minutes, 30 minutes, 1 hour, 2 hours, 3 hours, or 4 hours.

As used herein, substantially inactive at neutral pH means that the enzyme, when at neutral pH, exhibits less than 10% of the activity of the enzyme at its pH optima under similar conditions (except for the pH differences), i.e. assay, buffer, ionic strength.

As used herein, substantially active at pH 5.5 means that the enzyme, when at pH 5.5, exhibits greater than 10%, for example, 20%, 30%, 40%, 50%, 60%, 70%, 80%, 90%, 95%, 96%, 97%, 98%, 99% or 100% of the activity of the enzyme at its pH optima under similar conditions (except for the pH differences), i.e. assay, buffer, ionic strength.

As used herein, sub-epidermal administration refers to any administration that results in delivery of the enzyme under the outer-most layer of the skin. Sub-epidermal administration does not include topical application onto the outer layer of the skin. Examples of sub-epidermal administrations include, but are not limited to, subcutaneous, intramuscular, intralesional and intradermal routes of administration.

As used herein, substrate refers to a molecule that is cleaved by an enzyme. Minimally, a target substrate includes a peptide containing the cleavage sequence recognized by the protease, and therefore can be two, three, four, five, six or more residues in length. A substrate also includes a full-length protein, allelic variant, isoform or any portion thereof that is cleaved by an enzyme. Additionally, a substrate includes a peptide or protein containing an additional moiety that does not affect cleavage of the substrate by the enzyme. For example, a substrate can include a four amino acid peptide, or a full-length protein chemically linked to a fluorogenic moiety.

As used herein, cleavage refers to the breaking of peptide bonds or other bonds by an enzyme that results in one or more degradation products.

As used herein, activity refers to a functional activity or activities of a polypeptide or portion thereof associated with a full-length (complete) protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, enzymatic activity or catalytic activity or cleavage activity refers to the activity of a protease as assessed in in vitro proteolytic assays that detect proteolysis of a selected substrate.

As used herein, an active enzyme refers to an enzyme that exhibits enzymatic activity. For purposes herein, active enzymes are those that cleave any one or more components of the ECM, such as collagen. Active enzymes include those in single-chain or two-chain form.

As used herein, an inactive enzyme refers to an enzyme that exhibits substantially no activity (i.e. catalytic activity or cleavage activity), such as less than 10% of the maximum activity of the enzyme. The enzyme can be inactive by virtue of its conformation, the absence of an activating conditions required for its activity, or the presence of an inhibitor or any other condition or factor or form that renders the enzyme substantially inactive.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, a hyaluronan degrading enzyme refers to an enzyme that catalyzes the cleavage of a hyaluronan polymer (also referred to as hyaluronic acid or HA) into smaller molecular weight fragments. Exemplary of hyaluronan degrading enzymes are hyaluronidases, and particular chondroitinases and lyases that have the ability to depolymerize hyaluronan. Exemplary chondroitinases that are hyaluronan degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase comprises two enzymes, chondroitin-sulfate-ABC endolyase (EC 4.2.2.20) and chondroitin-sulfate-ABC exolyase (EC 4.2.2.21). Exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO: 306; Sato et al. (1994) *AppL Microbiol. Biotechnol.*41(1):39-46). Exemplary chondroitinase AC enzymes from the bacteria include, but are not limited to, those from *Flavobacterium heparinum Victivallis vadensis*, set forth in SEQ ID NO:308, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2):121-4; Michelacci et al. (1976) *J. Biol. Chem.* 251: 1154-8; Tsuda et al. (1999) *Eur. J. Biochem.* 262:127-133).

As used herein, hyaluronidase refers to an enzyme that degrades hyaluronic acid. Hyaluronidases include bacterial hyaluronidases (EC 4.2.99.1), hyaluronidases from leeches, other parasites, and crustaceans (EC 3.2.1.36), and mammalian-type hyaluronidases (EC 3.2.1.35). Hyaluronidases also include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include any set forth in any of SEQ ID NOS: 237-260. Exemplary human hyaluronidases include HYAL1 (SEQ ID NO:262), HYAL2 (SEQ ID NO:263), HYAL3 (SEQ ID NO:264), HYAL4 (SEQ ID NO:265), and PH20 (SEQ ID NO:232). Also included amongst hyaluronidases are soluble human PH20 and soluble rHuPH20.

Reference to hyaluronidases includes precursor hyaluronidase polypeptides and mature hyaluronidase polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 60%, 65%, 70%, 75%, 80%, 85%, 90%, 95%, 96%, 97%, 98%, 99% or more sequence identity to the precursor polypeptide set forth any of SEQ ID NO:232 or the mature form thereof. Hyaluronidases also include those that contain chemical or posttranslational modifications and those that do not contain chemical or posttranslational modifications. Such modifications include, but are not limited to, pegylation, albumination, glycosylation, farnesylation, carboxylation, hydroxylation, phosphorylation, and other polypeptide modifications known in the art.

As used herein, soluble human PH20 or sHuPH20 include mature polypeptides lacking all or a portion of the glycosylphosphatidylinositol (GPI) attachment site at the C-terminus such that upon expression, the polypeptides are soluble. Exemplary sHuPH20 polypeptides include mature polypeptides having an amino acid sequence set forth in any one of SEQ ID NOS:226-231. The precursor polypeptides for such exemplary sHuPH20 polypeptides include an amino acid signal sequence. Exemplary of a precursor is set forth in SEQ ID NOS:225, which contains a 35 amino acid signal sequence at amino acid positions 1-35. Soluble HuPH20 polypeptides can be degraded during or after the production and purification methods described herein.

As used herein, soluble rHuPH20 refers to a soluble form of human PH20 that is recombinantly expressed in Chinese Hamster Ovary (CHO) cells. Soluble rHuPH20 is encoded by nucleic acid encoding amino acids 1-482 set forth in SEQ ID NO:225. Also included are DNA molecules that are allelic variants thereof and other soluble variants. The nucleic acid encoding soluble rHuPH20 is expressed in CHO cells which secrete the mature polypeptide. As produced in the culture medium there is heterogeneity at the C-terminus so that the product includes a mixture of species of SEQ ID NOS:226-231. Corresponding allelic variants and other variants also are included. Other variants can have 60%, 70%, 80%, 85%, 90%, 91%, 92%, 93%, 94%, 95%, 96%, 97%, 98%, 99% or more sequence identity with any of SEQ ID NOS:226-231 as long they retain a hyaluronidase activity and are soluble.

As used herein, hyaluronidase activity refers to any activity exhibited by a hyaluronidase polypeptide. Such activities can be tested in vitro and/or in vivo and include, but are not limited to, enzymatic activity, such as to effect cleavage of hyaluronic acid, ability to act as a dispersing or spreading agent and antigenicity. Exemplary assays include the microturbidity assay (see e.g. Example 16) that measures cleavage of hyaluronic acid by hyaluronidase indirectly by detecting the insoluble precipitate formed when the uncleaved hyaluronic acid binds with serum albumin.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J Biol. Chem.*, 243:3557-3559 (1968), and adopted 37 C.F.R. §§ 1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |

TABLE 1-continued

Table of Correspondence

| SYMBOL | | |
|---|---|---|
| 1-Letter | 3-Letter | AMINO ACID |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic Acid |
| Z | Glx | Glu and/or Gln |
| W | Trp | Tryptophan |
| R | Arg | Arginine |
| D | Asp | Aspartic Acid |
| N | Asn | Asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§ 1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, "naturally occurring amino acids" refer to the 20 L-amino acids that occur in polypeptides.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991; Carillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I):387 (1984)), BLASTP, BLASTN, FASTA (Atschul, S.F., et al., *J Molec Biol* 215:403 (1990)); Guide to Huge Computers, Martin J. Bishop, ed., Academic Press, San Diego, 1994, and Carillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, WI) and the University of Wisconsin Genetics Computer Group (UWG) "Gap" program (Madison WI). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman (1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared, no more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly produced. In one embodiment, the term substantially free of cellular material includes preparations of enzyme proteins having less that about 30% (by dry weight) of non-enzyme proteins (also referred to herein as a contaminating protein), generally less than about 20% of non-enzyme proteins or 10% of non-enzyme proteins or less that about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, operably or operatively linked when referring to DNA segments means that the segments are arranged so that they function in concert for their intended purposes, e.g., transcription initiates in the promoter and proceeds through the coding segment to the terminator.

As used herein the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomasie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity) a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, a kit is a packaged combination that optionally includes other elements, such as additional reagents and instructions for use of the combination or elements thereof. In particular, for purposes herein, a "kit" refers to a combination of an activatable matrix-degrading enzyme provided herein and another item for a purpose including, but not limited to, activation, administration, diagnosis, and assessment of a biological activity or property. Kits optionally include instructions for use.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving components of the ECM.

As used herein, an ECM-mediated disease or condition is one where any one or more ECM components is involved in the pathology or etiology. For purposes herein, an ECM-mediated disease or conditions includes those that are caused by an increased deposition or accumulation of one or more ECM component. Such conditions include, but are not limited to, cellulite, Duputyren's syndrome, Peyronie's disease, frozen shoulders, existing scars such as keloids, scleroderma and lymphedema.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a pharmaceutically effective agent, includes any therapeutic agent or bioactive agents, including, but not limited to, for example, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, an effective amount is the quantity of a therapeutic agent necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass activatable matrix degrading enzymes contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The enzymes provided herein are from any source, animal, plant, prokaryotic and fungal. Most enzymes are of animal origin, including mammalian origin.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. The Extracellular Matrix

Provided herein are activatable matrix-degrading enzymes (AMDE) that degrade one or more protein components of the extracellular matrix (ECM) in a time controlled manner. By virtue of such targeting and the temporal in vivo activation, diseases and/or conditions of the ECM can be treated. The activatable matrix-degrading enzyme can degrade any component of the ECM; enzyme selection can depend upon the targeted component and/or the particular disease or condition to be treated.

The ECM makes up the connective tissue or interstitium that surrounds the spaces outside cells and the vascular and lymphatic system, thereby providing mechanical and structural support with and between different tissues. The complex and dynamic microenvironment of the ECM represents a structural and signaling system within connective tissues, such as the skin. Due to the complex nature of the ECM, it can serve diverse functions such as providing support and anchorage for cells, segregating tissues, regulating intercellular communication, and sequestering cellular growth factors. Defects or changes in the organization, or make-up, of the ECM can contribute to a number of diseases or conditions. For example, changes in the synthesis, degradation and organization of collagen fibers contribute to lipodystrophy (e.g., cellulite) and lymphedema.

The ECM is composed of fibrous structural proteins, such as collagens, polysaccharides, such as proteoglycans and hyaluronic acid, and adhesion proteins that link components of the matrix to each other and to cells. Some connective tissues, such as tendon and cartilage, are principally made up of ECM. The ECM making up the connective tissue of the skin, however, also is distributed with fibroblasts, blood vessels and other components. The ECM also serves as the space where water and its dissolved constituents move from the blood plasma to the lymphatics. The interstitial fluid is nearly isosmotic with the cytoplasm and is bicarbonate buffered providing an extracellular environment that is at neutral pH.

1. Components of the ECM

The ECM (also called the interstitial matrix) is a complex three-dimensional dynamic structure that contains numerous structural macromolecules including fibrous proteins such as collagens, elastin and fibronection, in which glycosyaminoglycans (GAGs) form a hydrated gel-like substance. The components of the ECM are produced by resident cells, typically fibroblasts or cells of the fibroblast family, and are secreted via exocytosis where they interact with other components of the ECM. It is the variation in the relative amount and the way in which the components organize and form together that give rise to diverse connective tissues such as bone, skin or cornea (Albert et al., "Cell Junctions, Cell Adhesions and the Extracellular Matrix." *Molecular Biology of the Cell*. New York: Garland Publishers, 1994. Page 972.)

a. Collagens

Collagen is the major structural constituent of connective tissues, such as the skin, and plays a role in the development and maintenance of tissue architecture, tissue strength and cell-cell interactions. Collagens include a family of structurally-related proteins of the ECM that contain one or more domains having the conformation of a collagen triple helix (Van der Rest et al. (1991) FASEB J., 5:2814-2823). Collagens contain a Gly-X-Y repeating structure, which allows collagen chains to twist into a helical structure. Each collagen molecule contains three chains twisted around each other to form a triple helix, designated $\alpha 1$-$\alpha 3$. The triple helix structure provides a high mechanical strength to a collagen molecule. There are at least 27 different types of collagens, which differ in amino acid sequence and chain composition. For example, depending on the type of collagen, the three chains forming the triple helix can be the same or different. Collagens can be homotrimeric (i.e. all three polypeptide chains of the triple helix are made up of the same collagen) or can be heterotypic (i.e. fibrils made of more than one collagen type). Collagens can be divided into several families depending on the structure they form. These include fibrillar collagens (also called interstitial collagens; e.g., Type I, II, III, V and XI) and non-fibrillar collagens such as facit (e.g., Type IX, XII, XIV), short chain (e.g., Type VIII, X), basement membrane (e.g., Type IV), and other collagens (e.g., Type VI, VII, and XIII). Table 2 below sets forth common collagen types and their representative location (Van der Rest et al. (1991) FASEB J., 5:2814-2823); www.collagenlife.com/page_1167323108078.html; www.indstate.edu/theme/mwking/extracellularmatrix.html).

Among the interstitial collagens, collagen molecules associate to form large fibrils, which have a distinctive banding pattern. The banding pattern results from overlap between adjacent molecules. The strength of collagen fibers is based on a multiplicity of intra- and intermolecular linkages of the collagen fibers that form the dense collagen fiber network of connective tissues. The most common of fibrillar collagens include type I, II and III collagens. Type I collagen is found in most connective tissues such as skin, bone, tendon and cornea, and is a made up of two α1(I) chains and one α2(I) chain ([α1(I)]$_2$(I)). Type II collagen is homotrimeric ([α1(II)]$_3$) and is predominantly found in the cartilage. Type III collagen also is homotrimeric ([α1(III)]$_3$) and is predominantly found in the skin and vessels.

Not all collagens form fibril networks. For example, the basement membrane type IV collagen is non-fibrous and has non-helical interruptions in the helix, which acts as a hinge giving the molecule greater flexibility. Thus, type IV collagen forms a sheet made by a meshwork of filaments rather than by linear fibrils.

The most abundant protein of the skin is collagen, which is primarily made up of type I(80-85%) and type III (8-11%) of the total collagen of the skin. Type I collagen associates with type III collagen to form the major collagen fibers of the dermis. The tensile strength of skin is due predominantly to these fibrillar collagen molecules, which assemble into microfibrils in a head-to-tail and staggered side-to-side lateral arrangement. Collagen molecules become cross-linked to adjacent collagen molecules, creating additional strength and stability in collagen fibers. For example, type V collagen also associates with type I/III collagen fibers, and regulates the fibril diameter. Other collagen types in the skin include, for example, type IV, type VI, type VII, type XII, type XIV and type XVII.

TABLE 2

Types of Collagens

| Type | Molecule Composition | Representative tissue |
|---|---|---|
| Fibrillar Collagens | | |
| I | [α1(I)]$_2$ [α2(I)] | Skin, bone, tendon, dentin, ligaments, interstitial tissues |
| II | [α1(II)]$_3$ | Cartilage, vitreous humor |
| III | [α1(III)]$_3$ | Skin, muscle, blood vessels; frequently associated with type I |
| V | [α1(V)][α2(v)][α3(V)] | Similar to Type I, also cell cultures, fetal tissues; associates with Type I |
| XI | [α1(XI)][α2(XI)][α3(XI)] | Cartilage, intervertebral cartilage and bone enamel |
| Non-fibrillar collagens | | |
| IV | [α1(IV)]$_2$ [α2 (IV)] | Basement membrane |
| VI | [α1(VI)][α2(VI)][α3(VI)] | Most interstitial tissues; associates with type I |
| VII | [α1(VII)]$_3$ | epithelia |
| VIII | [α1(VIII)]$_3$ | Unknown, some endothelial cells |
| IX | [α1(IX)][α2(IX)][α3(IX)] | Cartilage; associates with Type II |
| X | [α1(X)]$_3$ | Heterotrophic and mineralizing cartilage |
| XII | [α1(XII)]$_3$ | Ligaments, tendons and tooth enamel; interacts with types I and III | b. Elastin

A network of elastic fibers in the ECM provides flexibility to tissues that require resilience to recoil after stretching, such as the skin, arteries and lungs. The main component of elastic fibers is the elastin molecule, which creates cross-links to adjacent elastin molecules. These molecules form a core of elastic fibers and are covered by fibrillin, a large glycoprotein that binds to elastin and is important for the integrity of elastic fibers.

c. Fibronectin

Fibronectin is a glycoprotein that exists as a pair of two large subunits joined by a pair of disulfide bonds near the carboxyl termini. Each subunit contains functionally distinct domains specific for other matrix macromolecules and receptors on the surface of cells. For example, distinct domains on fibronectin bind collagen (separate domains for types I, II and III), heparin, fibrin and cell surface receptors such as integrins. Fibronectin is present in both plasma and tissue. In tissue, fibronectin functions to link together different types of ECM molecules and cells. It also contains an important cell-binding domain made up of the three amino acids, Arg-Gly-Asp (RGD), which is recognized by integrin receptors in the plasma membranes of cells. The binding of fibronectin molecules to integrin receptors on cells leads to the stimulation of signaling pathways that promote cell attachment, migration and differentiation. These characteristics allow fibronection to play an important role in cell adhesion and to communicate signals between cells and components of the ECM.

d. Glycosaminoglycans (GAGs)

GAGs are unbranched polysaccharide chains made of repeating disaccharide units that are strongly hydrophilic. GAGs are highly negatively charged and therefore attract osmotically active Na$^+$, causing large amounts of water to be drawn into their structure to keep the ECM hydrated. GAGs, such as dermatan sulfate, typically contain multiple glycosaminoglycan chains of 70-200 sugars long (formed from repeating disaccharide units) that branch from a linear protein core. This results in GAGs occupying a huge volume relative to their mass and forming gels at very low concentrations. The hydrophilic nature of GAGs causes a swelling pressure, or turgor, which allows the ECM to withstand compression forces.

In the ECM, GAGs are attached to ECM proteins to form proteoglycans or, in the case of hyaluronic acid (also called hyaluronan), exist as a non-proteoglycan matrix component. Extracellular proteoglycans are large, highly hydrated molecules that help cushion cells in the ECM. Glycosaminoglycans such as hyaluronan contribute to the "ground substance" by creating a barrier to bulk fluid flow through the interstitial collagenous matrix by way of their viscosity and water of hydration. Proteoglycans and non-proteoglycan GAGs associate to form large polymeric complexes in the ECM. They associate with each other, and also with fibrous proteins such as collagen.

i. Proteoglycans

There are three main types of GAGs that form proteoglycans of the ECM, including dermatan sulfate and chondroitin sulfate, heparin and heparan sulfate, and keratan sulfate. Generally, a proteoglycan is 95% carbohydrate by weight, typically in the form of long unbranched GAG chains. Besides providing hydrated space around cells, proteoglycans also regulate traffic of molecules and cells, bind signaling molecules thereby playing a role in cell activation, and bind other secreted proteins such as proteases and protease inhibitors to regulate the activities of secreted proteins (Albert et al., "Cell Junctions, Cell Adhesions and the Extracellular Matrix." *Molecular Biology of the Cell*. New York: Garland Publishers, 1994. pp. 972-978.) For example, the heparin sulfate chains of proteoglycans bind to several different growth factors, including fibroblast growth factors (FGFs), helping them to bind to their specific cell surface receptors.

Aggrecan is a proteoglycan, which principally contains chondroitin sulfate and heparan sulfate GAGs, and is typically found in cartilage forming large aggregates with hyaluronan to provide mechanical support. Decorin is another exemplary GAG of connective tissues made up primarily of chondroitin sulfate and dermatan sulfate GAGs. It binds to type I collagen fibrils. Perlecan and betaglycan are other exemplary proteoglycans of the ECM. Not all proteoglycans are associated with the ECM: for example, serglycin is associated with secretory vesicles where it helps to package and store secretory molecules, and syndecans are found on the cell surface and act as co-receptors (Albert et al., "Cell Junctions, Cell Adhesions and the Extracellular Matrix." *Molecular Biology of the Cell*. New York: Garland Publishers, 1994. pp. 972-978.)

Heparan sulfate proteoglycans (HSPGs) are ubiquitous macromolecules associated with the cell surface and extracellular matrix (ECM) of a wide range of cells of vertebrate and invertebrate tissues (Wight, T. N., Kinsella, M. G., and Qwamstromm, E. E. (1992) *Curr. Opin. Cell Biol.*, 4, 793-801; Jackson, R. L., Busch, S. J., and Cardin, A. L. (1991) *Physiol. Rev.*, 71, 481-539; Wight, T. N. (1989) *Arteriosclerosis*, 9, 1-20; Kjellen, L., and Lindahl, U. (1991) *Annu. Rev. Biochem.*, 60, 443-475; and Ruoslahti, E., and Yamaguchi, Y. (1991) *Cell*, 64, 867-869). The basic HSPG structure consists of a protein core to which several linear heparan sulfate chains are covalently attached. The polysaccharide chains are typically composed of repeating hexuronic and D-glucosamine disaccharide units that are substituted to a varying extent with N- and O-linked sulfate moieties and N-linked acetyl groups. Studies on the involvement of ECM molecules in cell attachment, growth and differentiation revealed a central role of HSPGs in embryonic morphogenesis, angiogenesis, metastasis, neurite outgrowth and tissue repair. The heparan sulfate (HS) chains, which are unique in their ability to bind a multitude of proteins, ensure that a wide variety of effector molecules cling to the cell surface. HSPGs are also prominent components of blood vessels. In large vessels they are concentrated mostly in the intima and inner media, whereas in capillaries they are found mainly in the subendothelial basement membrane where they support proliferating and migrating endothelial cells and stabilize the structure of the capillary wall. The ability of HSPGs to interact with ECM macromolecules such as collagen, laminin and fibronectin, and with different attachment sites on plasma membranes suggests a key role for this proteoglycan in the self-assembly and insolubility of ECM components, as well as in cell adhesion and locomotion.

ii. Hyaluronic Acid

Hyaluronic acid (HA; also called hyaluronan) is a large GAG that attracts water, and when bound to water exists in a viscous, gel-like form. Thus, HA serves as a lubricant, holding together gel-like connective tissues. HA is a polymer of disaccharides (sometimes as many as 25,000 repeats in length) and is composed of repeating units of two modified simple sugars: glucuronic acid and N-acetyl glucosamine. HA is part of the ECM of many connective tissues. HA is found in the greatest amount in the skin with almost 50% of the body's HA found in the skin. The HA provides continuous moisture to the skin by binding up water. Decreased production of HA, such as by age, results in wrinkled and unhealthy skin.

HA, principally through its receptor CD44, also functions to regulate cell behavior during embryonic development and morphogenesis, wound healing, repair and regeneration, inflammation and tumor progression and invasion (Harada et al. (2006) *J. Biol. Chem.*, 8:5597-5607). HA is degraded by hyaluronidases. The degradation products of HA can be found in increased amounts in damaged or growing tissues, and in a variety of inflammatory conditions. HA fragments promote angiogenesis and can stimulate cytokine production by macrophages and dendritic cells in tissue injury and skin transplant.

2. Histology of the Skin

The skin is composed of several distinct layers, principally the epidermis and dermis. The epidermis is a specialized epithelium derived from the ectoderm, and beneath this is the dermis, which is a derivative of the mesoderm and is a vascular dense connective tissue. These two layers are firmly adherent to one another and form a region which varies in overall thickness form approximately 0.5 to 4 mm in different areas of the body. Beneath the dermis is a layer of loose connective tissue, which varies from areolar to adipose in character. This is referred to as the hypodermis, but is typically considered not to be part of the skin. The dermis is connected to the hypodermis by connect tissue fibers that pass from one layer to the other.

a. The Epidermis

The epidermis is the skin layer directly above the dermis, and is the surface layer of the skin. The principle function of the epidermis is to act as a protective barrier against water loss, chemical injury and invading pathogens. The epidermis is a thin layer of approximately fifteen cell layers that is about 0.1 to 1.5 millimeters thick composed primarily of keratinocytes (Inlander, Skin, New York, N.Y.: People's Medical Society, 1-7 (1998)). The epidermis is itself divided into several layers (e.g., stratum basale, stratum spinosum, stratum granulosum, stratum lucidum, stratum corneum) based on the state of differentiation of the keratinocytes. Keratinocytes originate in the basal layer from keratinocyte stem cells. As the keratinocytes grow and divide, they undergo gradual differentiation eventually reaching the stratum corneum where they form a layer of enucleated, flattened, highly keratinized cells called squamous cells (also called corneocytes). Besides being made up of corneocytes, the stratum corneum also contains sebum. The sebum is secreted by sebaceous glands, which are usually found in hair-covered areas connected to hair follicles. Sebum is a slightly acid layer that helps to hold the corneocytes together and holds moisture in. This acidity is due to the presence of amphoteric amino acids, lactic acid and fatty acids that make up sebum. Thus, the pH of the skin surface is normally between 5 and 6, typically about 5.5. Sebum acts to waterproof hair and skin, and keep them from becoming dry, brittle and cracked, and it also inhibits the growth of microorganisms on skin. The term "acid mantle" refers to the presence of the water-soluble substances on most regions of the skin.

b. The Dermis

The connective tissue of the skin is called the dermis. The dermis is 1.5 to 4 milliliters thick. In the skin, the dermis contains ECM components; the main protein components are collagen and elastin. The dermis also is home to most of the skin's structures, including sweat and oil glands that secrete substances through openings in the skill called pores, or comedos, hair follicles, nerve endings, and blood and lymph vessels (Inlander, Skin, New York, N.Y.: People's Medical Society, 1-7 (1998)).

c. The Hypodermis

Below the dermis is the hypodermis, which is a fatty layer and is the deepest layer of the skin. It acts both as an insulator for body heat conservation and as a shock absorber for organ protection (Inlander, Skin, New York, N.Y.: People's Medical Society, 1-7 (1998)). In addition, the hypodermis also stores fat for energy reserves.

3. Diseases of the ECM

Certain diseases and conditions result from defects or changes in the architecture of the extracellular matrix due to aberrant expression or production of ECM components. For example, in some inflammatory conditions such as occur upon wound healing, cytokines are secreted, which stimulate fibroblasts to secrete ECM components such as collagen. The ECM components accumulate and become locally deposited, resulting in a wide range of fibrotic conditions. Matrix deposition is a frequent feature in many chronic inflammatory diseases and in other diseases and conditions. Included among these are collagen-mediated disease conditions such as, but not limited to, scars such as keloid and hypertrophic scars, Duputyren's syndrome, Peyronie's disease and lymphedema. Cellulite also is a prominent disease of the ECM that, in addition to increased adipogenicity, is characterized by alterations in the connective tissue matrix resulting in an abnormal fibrous septae network of collagen (Rawlings et al. (2006) Int. J. Cos. Science, 28:175-190).

Diseases and conditions of the ECM that are characterized by aberrant expression or overproduction of matrix components, resulting in their accumulation and unwanted deposition, can be treated by the activatable matrix-degrading enzymes provided herein. By virtue of the temporal activation of such enzymes upon in vivo administration, the treatment of such diseases and conditions is regulated to limit the enzymatic degradation of the matrix components. For example, by limiting the duration of action of matrix degradation, unwanted side effects associated with uncontrolled protein degradation is minimized.

C. Matrix-Degrading Enzymes

Provided herein are compositions, combinations and containers containing activatable matrix-degrading enzymes, and methods of using activatable matrix-degrading enzymes to treat ECM-mediated diseases or conditions. Matrix-degrading enzymes degrade protein components or glycoproteins of the ECM, including, but not limited to, collagen, elastin, fibronectin and proteoglycans. By virtue of their ability to cleave one or more ECM components, activatable matrix-degrading enzymes provided herein can be used to modify the matrix of tissues, particularly those exhibiting structural defects or changes due to excess of one or more ECM protein or unwanted accumulation of fibrous tissue rich in one or more ECM proteins, such as collagen. Thus, such enzymes are useful in treating diseases or conditions in which ECM proteins are involved.

Among matrix-degrading enzymes are proteases and glycosyl hydrolases. Hence, matrix-degrading enzymes include proteins that are protein-degrading enzymes that recognize sequences of amino acids or a polypeptide substrate within a target protein and also hydrolases that recognize non-peptide bonds such as ester bonds or glycosyl groups. Among proteases are exoproteases of the serine, cysteine, aspartic and metallo-protease families. Upon recognition of the substrate sequence, proteases catalyze the hydrolysis or cleavage of a target protein. Such hydrolysis of a target protein, depending on the location of the peptide bond within the context of the full-length sequence of the target sequence, can inactivate, or in some instances activate, a target.

Several distinct types of catalytic mechanisms are used by proteases (Barret et al. (1994) *Meth. Enzymol.* 244:18-61; Barret et al. (1994) *Meth. Enzymol* 244:461-486; Barret et al. (1994) *Meth. Enzymol.* 248:105-120; Barret et al. (1994) *Meth. Enzymol.* 248:183-228). Based on their catalytic mechanism, the proteases that cleave peptide bonds are subdivided into serine-, cysteine-, aspartic-, threonine- and metallo-proteases. Serine-type peptidases have a serine residue involved in the active center, aspartic-type peptidases have two aspartic acids in the catalytic center, cysteine-type peptidases have a cysteine residue, threonine-type peptidases have a threonine residue, and metallo-peptidases use a metal ion in the catalytic mechanism. The catalytic activity of the proteases is required to cleave a target substrate. Serine and metalloproteinases are most active at neutral pH, while cysteine and aspartic proteases, found predominantly in lysosomes, have acidic pH optima. Thus, lysosomal proteases include proteases of the cysteine and aspartic protease families. Other families of enzymes include the hydrolases such as esterases that act on ester bonds and glycolases that hydrolyze O- or S-glycosyl compounds or N-glycosyl compounds. Exemplary of a glycosyl hydrolase is heparanase.

Exemplary matrix-degrading enzymes are set forth in TABLE 3 (see e.g., Chapman et al., *Am J. Physiol Heart Circ. Physiol.* (2004) 286: 1-10; Iozzo R V, *Proteoglycans: Structure, biology, and Molecular Interactions*, CRC Press (2000), pp. 94-96; Owen et al. (1999) J. Leuk. Biol., 65:137-150; Buhling et al. (2004) *Eur. Respir. J.,* 23:620-628; Thomas Kreis and Ronald Cale, *Extracellular Matrix, Anchor and Adhesion Proteins*, Oxford University Press (1999) pp. 515-523; Ian M. Clark and Gillian Murphy. "Matrix Proteinases," in Dynamics of Bone and Cartilage Metabolism, Academic Press (2006), pp. 181-198; Buck et al. (1992) Biochem J., 282:273-278). The sequence identifiers (SEQ ID NO) for the nucleotide sequence (mRNA) and encoded amino acid sequence of the precursor polypeptide for each of the exemplary proteases are depicted in the Table. The sequence identifiers (SEQ ID NO) for the amino acid sequence of the proprotein for each of the exemplary proteases also are depicted in the Table, as well as the amino acid positions within the proprotein that correspond to the propeptide. Variations also exist among allelic and species variants and other variants known in the art, and such variants also are contemplated for use as activatable enzymes. The Table also sets forth exemplary ECM target substrates for each enzyme. Reference to such substrates is for reference and exemplification, and are not intended to represent an exhaustive list of all target substrates. One of skill in the art knows or can empirically determine ECM target substrates for a desired enzyme using routine assays, just as any described herein.

Matrix-degrading enzymes can be produced or isolated by any method known in the art including isolation from natural sources, isolation of recombinantly produced proteins in cells, tissues and organisms and by recombinant methods and by methods including in silico steps, synthetic methods and any methods known to those of skill in the art. Typically, enzymes are produced or isolated in an inactive form. Conditional activation can be achieved as described below.

TABLE 3

Matrix-Degrading Enzymes

| | | | | SEQ ID NO | | |
| --- | --- | --- | --- | --- | --- | --- |
| | | Enzyme | | | Precursor | |
| Protease | Substrate | databank access code (EC) www.expasy.ch/sprot/enzyme.html | GenBank No. | nt | aa (aa of signal sequence(ss); aa of propeptide (pp) | mature aa |

Serine Protease

| Protease | Substrate | EC | GenBank No. | nt | Precursor aa | mature aa |
| --- | --- | --- | --- | --- | --- | --- |
| Pancreatic elastase (PE1; Elastase-1) | elastin | 3.4.21.36 | Q9UNI1; NM_001971 | 19 | 20 (ss aa 1-8; pp aa 9-18) | 21 |
| Elastase-2A | elastin | 3.4.21.71 | P08217; NM_033440 | 22 | 23 (ss aa 1-16; pp aa 17-28) | 24 |
| Elastase-2B | elastin | 3.4.21.71 | P08218; NM_015849 | 25 | 26 (aa aa 1-16; pp aa 17-28) | 27 |
| Neutrophil elastase (NE; leukocyte elastase; elastase-2) | Elastin, fibronectin, laminin, collagen type II, IV, VI, proteoglycans | 3.4.21.37 | P08246 NM_001972 | 28 | 29 (ss aa 1-17; pp aa 28-29) | 30 |
| Proteinase-3 (PR-3; myeloblastin) | elastin, fibronectin, laminin, vitronectin, collagen type IV | 3.4.21.76 | P24158 NM_002777 | 31 | 32 (ss aa 1-25; pp aa 26-27, 249-256) | 33 |
| Endogenous vascular elastase (EVE; tissue elastase; complement factor D) | elastin | 3.4.21.46 | S73894 (*Rattus* sp.) | 34 | 35 (ss aa 1-20; pp aa 21-25) | 36 |
| Cathepsin G | collagen type IV, laminin, fibronectin, proteoglycan, elastin | EC 3.4.21.20 | P08311 NM_001911 | 37 | 38 (ss aa 1-18; pp aa 19-20) | 39 |
| Mast cell chymase | collagen type IV, laminin, fibronectin, proteoglycan | 3.4.21.39 | P23946 NM_001836 | 40 | 41 (ss aa 1-19; pp aa 20-21) | 42 |
| Mast cell tryptase | fibronectin, fibrinogen, collagen type IV, proteoglycan | 3.4.21.59 | Q9BZJ3 NM_012217 | 43 | 44 (ss aa 1-18; pp aa 19-30) | 45 |
| Plasmin | Proteoglycan, fibronectin, laminin | 3.4.21.7 | P00747 NM_000301 | 46 | 47 (ss aa 1-19; pp aa 20-97) | 48 |
| Thrombin | proteoglycan | 3.4.21.5 | P00734 NM_000506 | 49 | 50 (ss aa 1-24; pp aa 25-43) | 51 |
| Granzyme B | proteoglycan | 3.4.21.79 | P10144 NM_004131 | 52 | 53 (ss aa 1-18; pp aa 19-20) | 54 |

Cysteine Protease

| Protease | Substrate | EC | GenBank No. | nt | Precursor aa | mature aa |
| --- | --- | --- | --- | --- | --- | --- |
| Cathepsin S | Elastin, collagen | EC 3.4.22.27 | P25774 NM_004079 | 55 | 56 (ss 1-16; pp 17-114) | 57 |
| Cathepsin K | elastin, collagen I and III | EC 3.4.22.38 | P43235 NM_000396 | 58 | 59 (ss aa 1-15; pp aa 16-114) | 60 |
| Cathepsin L | elastin, collagen I and IV | EC 3.4.22.15 | P07711 | 61 | 62 (ss aa 17; pp aa 18-113) | 1 |

TABLE 3-continued

Matrix-Degrading Enzymes

| Protease | Substrate | Enzyme databank access code (EC) www.expasy.ch/sprot/enzyme.html | GenBank No. | SEQ ID NO | | |
|---|---|---|---|---|---|---|
| | | | | | Precursor | |
| | | | | nt | aa (aa of signal sequence(ss); aa of propeptide (pp) | mature aa |
| Cathepsin B | Collagen IV, laminin, fibronectin | EC 3.4.22.1 | P07858 NM_001908 | 63 | 64 (ss aa 1-17; pp aa 18-79) | 65 |
| Cathepsin C | Proteoglycans (decorin) | EC 3.4.14.1 | P53634 NM_001814 | 178 | 179 (ss aa 1-24; pp aa 135-230) | 180 |
| Cathepsin H | fibronectin | EC 3.4.22.16 | P09668 X16832 | 66 | 67 (ss aa 1-22; pp aa 23-97) | 68 |
| Cathepsin F | Collagen fragments | EC 3.4.22.41 | Q9R013 NM_019861 (*Mus musculus*) | 69 | 70 (ss aa 1-19; pp aa 20-248) | 71 |
| Cathepsin F | Collagen fragments | EC 3.4.22.41 | Q9UBX1 NM_003793 | 181 | 182 (ss aa 1-19; pp 20-270) | 183 |
| Cathepsin O | fibrinogen | EC 3.4.22.42 | Q8BM88 NM_177662 (*mus musculus*) | 72 | 73 (aa aa 1-23; pp aa 24-98) | 74 |
| Cathepsin O | fibrinogen | EC 3.4.22.42 | P43234 NM_001334 | 184 | 185 (ss aa 1-23; pp aa 24-107) | 186 |
| Cathepsin R | | EC3.4.22.— | Q9JIA9 NM_020284 (*mus musculus*) | 75 | 76 (ss aa 1-17; pp aa 18-114) | 77 |
| Cathepsin V (Cathepsin L2) | collagen | EC 3.4.22.43 | O60911 NM_001333 | 187 | 188 (ss aa 1-17; pp aa 18-113) | 189 |
| Cathepsin W | | EC 3.4.22.— | P56202 NM_001335 | 78 | 79 (ss aa 1-21; pp aa 22-127) | 80 |
| Calpain 1 | fibronectin, vitronectin, proteoglycans | EC 3.4.22.52 | Calpain 1 large subunit: P07384 NM_005186 | 81 | | 82 |
| Calpain 2 | fibronectin, vitronectin, proteoglycans | EC3.4.22.53 | Calpain 2 large subunit: P17655 NM_001748 | 83 | 84 (aa 1 initiating methionine) | 85 |
| | | | Calpain small subunit 1 (associates with Calpain 1 and 2 large subunits) P04632 NM_001749 | 86 | | 87 |
| Legumain | | EC 3.4.22.34 | Q99538 NM_005606 | 190 | 191 (ss aa 1-17; pp aa 324-433) | 192 |
| Cathepsin Z (cathepsin X) | | EC 3.4.22.— | Q9UBR2 NM_001336 | 193 | 194 (ss aa 1-23; pp aa 24-61) | 195 |
| Aspartic Protease | | | | | | |
| Cathepsin D | proteoglycan | EC 3.4.23.5 | P07339 NM_001909 | 88 | 89 (ss aa 1-18; pp aa 19-64) | 90 |
| Cathepsin E | proteoglycan | EC 3.4.23.34 | P14091 Isoform a NM_001910 | 91 | 92 (ss aa 1-17; pp aa 18-53) | 93 |
| | | | Isoform b NM_148964 | 94 | 95 (ss aa 1-17; pp aa 18-53) | 96 |

TABLE 3-continued

Matrix-Degrading Enzymes

| | | | | SEQ ID NO | | |
|---|---|---|---|---|---|---|
| | | Enzyme | | | Precursor | |
| Protease | Substrate | databank access code (EC) www.expasy.ch/sprot/enzyme.html | GenBank No. | nt | aa (aa of signal sequence(ss); aa of propeptide (pp)) | mature aa |

Metallo-Protease

| Protease | Substrate | EC | GenBank No. | nt | aa (ss/pp) | mature aa |
|---|---|---|---|---|---|---|
| MMP-1 (collagenase-1) | collagen I, II, III, VII, VIII, X, XI, gelatin, proteoglycan, fibronectin, glycoprotein | 3.4.24.7 | P03956, NM_002421 | 97 | 98 (ss aa 1-19; pp aa 20-99) | 99 |
| MMP-8 (collagenase-2) | collagen I, II, III, aggrecan | 3.4.24.34 | P22894 NM_002424 | 100 | 101 (ss aa 1-20; pp aa 21-100) | 102 |
| MMP-13 (collagenase-3) | collagen I, II, III, IV, VI, IX, X, XIV, gelatin, proteoglycan, fibronectin, glycoprotein | 3.4.24.— | P45452 NM_002427 | 103 | 104 (ss aa 1-19; pp aa 20-103) | 105 |
| MMP-18 (collagenase-4) | collagen I | 3.4.24.— | *Xenopus laevis* O13065 | 106 | 107 (ss aa 1-17; pp aa 18-99) | 108 |
| MMP-2 (gelatinase A) | gelatins, collagen I, II, III, IV, V, VII, X, XI, elastin, fibronectin, laminin, proteoglycan, glycoprotein | 3.4.24.24 | P08253 NM_004530 | 109 | 110 (ss aa 1-29; pp 30-109) | 111 |
| MMP-9 (gelatinase B) | gelatin, collagen IV, V, VI, XIV, elastin, laminin, proteglycan, glycoprotein | 3.4.24.35 | P14780 NM_004994 | 112 | 113 (ss aa 1-19; pp aa 20-93) | 114 |
| MMP-3 (stromelysin-1) | fibronectin, elastin, laminin, gelatin, proteoglycan, glycoprotein, collagen III, IV, V, VII, IX, X, XI | 3.4.24.17 | P08254 NM_002422 | 115 | 116 (ss aa 1-17; pp aa 18-99) | 117 |
| MMP-10 (stromelysin-2) | collagen III, IV, V, elastin, gelatin, fibronectin, aggrecan | 3.4.24.22 | P09238 NM_002425 | 118 | 119 (ss aa 1-17; pp aa 18-98) | 120 |
| MMP-11 (stromelysin-3) | Gelatin, fibronectin, laminin, collagen IV | 3.4.24.— | P24347 X57766 | 121 | 122 (ss aa 1-31; pp aa 32-97) | 123 |
| MMP-7 (matrilysin) | fibronectin, laminin, elastin, gelatin, collagen I, IV, proteoglycan, glycoprotein | 3.4.24.23 | P09237 NM_002423 | 124 | 125 (ss aa 1-17; pp aa 18-94) | 126 |
| MMP-26 (matrilysin-2) | collagen IV, fibronectin, gelatin, proteoglycan | 3.4.24.— | Q9NRE1 NM_021801 | 127 | 128 (ss aa 1-17; pp aa 18-89) | 129 |

TABLE 3-continued

Matrix-Degrading Enzymes

| Protease | Substrate | Enzyme databank access code (EC) www.expasy.ch/sprot/enzyme.html | GenBank No. | SEQ ID NO | | |
|---|---|---|---|---|---|---|
| | | | | | Precursor | |
| | | | | nt | aa (aa of signal sequence(ss); aa of propeptide (pp)) | mature aa |
| MMP-12 (metalloelastase) | elastin, fibronectin, laminin, collagen I, IV, V, gelatin, proteoglycan, glycoprotein | 3.4.24.65 | P39900 NM_002426 | 130 | 131 (ss aa 1-16; pp aa 17-105) | 132 |
| MMP-14 (MT1-MMP) | Collagen I, II, III, gelatin, aggregcan, fibronectin, laminin, proteoglycan, glycoprotein | 3.4.24.80 | P50281 NM_004995 | 133 | 134 (ss aa 1-20; pp aa 21-111) | 135 |
| MMP-15 (MT2-MMP) | aggregan, fibronectin, laminin, glycoprotein | EC 3.4.24.— | P51511 NM_002428 | 136 | 137 (ss aa 1-41; pp aa 42-131) | 138 |
| MMP-16 (MT3-MMP) | Collagen III, fibronectin, laminin, gelatin, proteoglycan | EC 3.4.24.— | P51512 NM_005941 | 139 | 140 (ss aa 1-31; pp aa 32-119) | 141 |
| MMP-17 (MT4-MMP) | gelatin | EC 3.4.24.— | Q9ULZ9 AB021225 | 142 | 143 (ss aa 1-38; pp aa 39-128) | 144 |
| MMP-24 (MT5-MMP) Transmembrane | fibronectin, gelatin, proteoglycan | EC 3.4.24.— | Q9Y5R2 NM_006690 | 309 | 310 (ss aa 1-52; pp aa 53-155) | 311 |
| MMP-25 (MT6-MMP) GPI anchor | collagen IV, gelatin, fibronectin, proteoglycan | EC 3.4.24.— | Q9NPA2 NM_022468 | 312 | 313 (ss aa 1-21; pp aa 22-107) | 314 |
| MMP-19 | collagen IV, gelatin, laminin, aggregan, fibronectin, glycoprotein | EC 3.4.24.— | Q99542 NM_002429 | 145 | 146 (ss aa 1-18; pp aa 19-97) | 147 |
| MMP-20 (enamelysin) | aggrecan | EC 3.4.24.— | O60882 Y12779 | 148 | 149 (ss aa 1-22; pp aa 23-107) | 150 |
| MMP-x (MMP-21) (XMMP) | No substrates defined | EC 3.4.24.— | O93470 NM_001085816 (Xenopus) | 151 | 152 (ss aa 1-22; pp aa 23-180) | 153 |
| MMP-21 | gelatin | EC 3.4.24.— | Q8N119 NM_147191 | 315 | 316 (ss aa 1-24; pp aa 25-144) | 317 |
| MMP-23 CA-MMP | gelatin | EC 3.4.24.— | O75900 AJ005256 | 318 | 319 | 320 |
| MMP-27 CMMP | gelatin | EC 3.4.24.— | Q9H306 NM_022122 | 321 | 322 (ss aa 1-17; pp aa 18-98) | 323 |
| MMP-28 (epilysin) | | EC 3.4.24.— | Q9H239 NM_024302 | 324 | 325 (ss aa 1-22; pp aa 23-122) | 326 |
| ADAMTS-1 | aggrecan | EC 3.4.24. | Q9UHI8 NM_006988 | 157 | 158 (ss aa 1-49; pp aa 50-252) | 159 |
| ADAMTS-2 | Procollagen I, procollagen II | EC 3.4.24. | O95450 AJ003125 | 160 | 161 (ss aa 1-29; pp aa 30-253) | 162 |
| ADAMTS-3 | Procollagen II | EC 3.4.24.14 | O15072 NM_014243 | 163 | 164 (aa 1-229) | 165 |
| ADAMTS-4 (aggrecanase-1) | aggrecan | EC 3.4.24.82 | O75173 NM_005099 | 166 | 167 (ss aa 1-51; pp aa 52-212) | 168 |

TABLE 3-continued

Matrix-Degrading Enzymes

| Protease | Substrate | Enzyme databank access code (EC) www.expasy.ch/sprot/enzyme.html | GenBank No. | SEQ ID NO | | |
|---|---|---|---|---|---|---|
| | | | | | Precursor | |
| | | | | nt | aa (aa of signal sequence(ss); aa of propeptide (pp) | mature aa |
| ADAMTS-5 (aggrecanase-2) | aggrecan | EC 3.4.24. | Q9UNA0 NM_007038 | 169 | 170 (ss aa 1-16; pp aa 17-261) | 171 |
| ADAMTS-14 | Procollagen I | EC 3.4.24. | Q8WXS8 Isoform a NM_139155 | 172 | 173 (ss aa 1-22; pp aa 23-252) | 174 |
| | | | Isoform a NM_080722 | 175 | 176 (ss aa 1-22; pp aa 23-252) | 177 |
| Other | | | | | | |
| Heparanase | Proteoglycan | EC 3.2.—.— | Q9Y251 AF152376 | 154 | 155 (ss aa 1-35; pp aa 110-157) | 156 |

1. Enzyme Activation

Most proteases are synthesized and secreted as inactive forms and require further processing to become active. Activation is typically achieved by conformational, steric or other changes that reveal the enzymes active site. With the exception of calpains, all protease enzymes are typically synthesized as zymogens. Zymogen activation prevents unwanted protein degradation that could occur if proteases were always present in an active form. Generally, zymogens contain N-terminal portions (or prosegments or proregions) that sterically block the active site of the protease and prevent access of substrates to the active site of the protease. The prosegments of the zymogens range in size from two residues to 150 residues. Upon secretion from a preproenzyme form, the proenzyme (containing the prosegment) is inactive.

Upon proteolytic removal of the prosegment of the zymogen, either autocatalytically or by other proteases, the active site of the enzyme is exposed resulting in a mature protease, and typically, activation. In some cases, however, additional cofactors also are required for complete activation. For example, pH change triggers the activation of enzymes of the cysteine, aspartic and metalloprotease families. Low pH acts to increase the susceptibility of the prosegment as a substrate during zymogen conversion or causes a conformational change in the prosegment or enzyme (Jerala et al. (1998) J Biol. Chem., 273:11498-11504). Lysosomal enzymes, such as cathepsins of the cysteine and aspartic protease families, require acidic conditions before complete activation is achieved. Besides pH, other cofactors include, but are not limited to, salt concentration, reducing agents such as cysteine, DTT and TCEP, metal ions such as calcium, heat or temperature. Thus, various mechanisms of zymogen conversion exist and vary between protease families (see e.g., Khan et al. (1998) Protein Science, 7:815-836; Khan et al. (1999) PNAS, 96: 10968-10975). For example, zymogen conversion to the active enzyme often occurs as a result of proteolysis by autocatalysis or actions of other proteases, changes in pH, or the involvement of accessory molecules or ions, or a combination or one or more of the above conditions. Further control over the time and location of action often is achieved by protein inhibitors (Stroud et al. (1977) Ann. Rev. Biophys. Bioeng., 6:177-93)

a. Serine Proteases

Serine proteases (SPs), which include secreted enzymes and enzymes sequestered in cytoplasmic storage organelles, have a variety of physiological roles, including blood coagulation, wound healing, digestion, immune responses and tumor invasion and metastasis. Many serine proteases degrade components of the extracellular matrix (see Table 2 above). For example, proteases involved in the degradation and remodeling of extracellular matrix (ECM) contribute to tissue remodeling, and are necessary for cancer invasion and metastasis.

The activity of proteases in the serine protease family is dependent on a set of amino acid residues that form their active site. One of the residues is always a serine; hence their designation as serine proteases. The mechanism of cleavage of a target protein by a serine protease is based on nucleophilic attack of the targeted peptidic bond by a serine. The catalytic serine forms a covalently-attached tetrahedral intermediate with the carbonyl atom of the scissile peptide bond of substrates. In many cases the nucleophilic property of the group is improved by the presence of a histidine, held in a "proton acceptor state" by an aspartate. Aligned side chains of serine, histidine and aspartate build the catalytic triad common to most serine proteases.

Most serine proteases exist as zymogens in the precursor form, and thus are inactive. In the zymogen form of the protease active site for catalysis is distorted compared to the active enzyme. In fact, serine proteases are the only family of proteases who have conformational differences in the active site between the zymogen and active form of the protease. Thus, the catalytic triad exists in the zymogen, but a distorted loop from the proenzyme partially obstructs the substrate-binding cleft. As a result, the substrate polypeptide cannot bind effectively, and proteolysis does not occur. Only after activation, during which the conformation and structure of the zymogen change and the active site is opened, can proteolysis occur.

Serine proteases are active at neutral pH. Zymogen conversion occurs following limited proteolysis, such as by highly specific catalytic cleavage by another protease or by auto-activation. For example, the conversion of the inactive prothrombin to the active form of the enzyme (thrombin) is achieved by a highly specific catalytic cleavage of the prosegment by another of the clotting enzymes (factor Xa). Other serine proteases use similar mechanisms, but the activation cleavage sites differ and thus serine proteases typically are activated by different convertases.

Granule-associated serine proteases, including but not limited to, granzymes A and B, cathepsin G, neutrophil elastase, proteinase 3, and mast cell tryptase and chymase require a dual proteolytic event for activation. These enzymes are synthesized as preproenzymes; cleavage of the signal peptide results in a proenzyme zymogen form that is inactive. Granule-associated serine proteases contain a prodipeptide at the N-terminus of the enzyme, and also contain a carboxyl-terminal extension which also must be removed for activation. The prodipeptide prevents folding of the mature enzyme into a catalytically active formation. Activation of the granule-associated serine proteases is achieved by cleavage of both the carboxy-terminal extension and the prodipeptide. Cathepsin C has been implicated in cleavage of the prodipeptide in at least some granule-associated serine proteases (Kummer et al. (1996) J Biol. Chem., 271:9281-9286).

b. Cysteine Proteases

Cysteine proteases contain a Cys-His pair in their active site, and their catalytic activation involves a cysteine sulfhydryl group. Deprotonation of the cysteine sulfhydryl by an adjacent histidine residue is followed by nucleophilic attack of the cysteine on the peptide carbonyl carbon. A thioester linking the new carboxy-terminus to the cysteine thiol is an intermediate of the reaction (comparable to the acyl-enzyme intermediate of a serine protease). Cysteine proteases include papain, cathepsin, caspases, and calpains. The mechanisms of activation of these different families of cysteine proteases differ.

i. Cathepsins

Papain-like cysteine proteases, including cathepsin, are a family of thiol dependent endo-peptidases related by structural similarity to papain. They form a two-domain protein with the domains labeled R and L (for right and left) and loops from both domains form a substrate recognition cleft. The cathepsins are synthesized as zymogens containing a prosegment; the prosegment acts as an N-terminal inhibitory prosegment. Although there is about 25% sequence identify among the mature enzymes, the prosegments exhibit little sequence similarity. The prosegment functions as a potent inhibitor of the mature enzyme. The prosegment also serves other functions such as playing a role in the folding and stability of the enzyme during synthesis and transport at neutral pH.

Cathepsins of the cysteine protease family are lysosomal enzymes and thus are optimally active below pH 7 and become inactive above pH 7. Cathepsins are synthesized as inactive precursors (i.e. zymogens), and are activated by proteolytic removal of the prosegment. This results in the generation of single-chain enzymes. Generally, the single chain enzymes can be processed into two chain forms containing a heavy chain and a light chain. Typically, the two chains are held together via noncovalent interactions or via disulfide bridges. Hence, mature cathepsins exist in single-chain or in two-chain form.

The removal of the prosegment can be facilitated either by activation by other proteases or by autocatalytic activation at acidic pH (Turk et al. (2001) The EMBO Journal, 20:4629-4633). The pH dependence of the zymogen conversion process is regulated by conserved salt bridges in the proseg-ment (e.g., Asp82p and Arg38p and Glu87p and Arg48p in procathepsin L set forth in SEQ ID NO:62). Disruption of the salt bridges by protonation of the carboxylate groups at the lower pH disrupts the hydrophobic core of the prosegment resulting in dissociation of the prosegment from the active site (Khan et al. (1998) Protein Science, 7:815-836). The residues conferring formation of salt bridges can differ between cathepsins. For example, pro-cathepsin B uses alternative salt-bridge interactions for its pH-dependent zymogen conversion (Coulombe et al. (1996) EMBO J., 15:5492-5503).

Acidic pH conditions are required for the activity of mature cathepsins; zymogen conversion itself is not sufficient for enzyme activity. In addition to its requirement for activity, the acidic pH also stabilizes the enzyme. Inactivation and destabilization of cathepsins at higher pH conditions is caused by deprotonation of the imidazole moiety of the active site —S$^-$/H$^+$im-ion pair, and "unzipping" of the structure along the active site groove (Dehrmann et al. (1995) Arch. Biochem. Biophys., 324:93-98). Hence, most cathepsins have optimal activity and stability at an acidic pH. For example, cathepsins B, F, H, K, L and V are optimally active in acidic environments and are only weakly active or not active at neutral pH (Lutgens et al. (2007) The FASEB J., 21: 3029-3041). Some cathepsins, e.g. cathepsin L, lose their activity quickly after incubation at a neutral pH. Some cathepsins maintain their enzymatic activity even after incubation at neutral pH, and thus can degrade matrix proteins under physiological conditions. Cathepsins C and S have been found to have the highest pH stability, while cathepsins K and V display intermediate pH stability. In vitro investigations have shown that cathepsin K can degrade fibril proteins at neutral pH. (Buhling et al. (2004) Eur. Respir. J, 23:620-628).

Cathepsin L

Cathepsin L (CatL) is a lysosomal acid cysteine protease that belongs to the papain family. The human cathepsin L gene encodes a 333 amino acid cysteine protease that contains a 17 amino acid signal peptide, a 96-amino acid propeptide and a 220 amino acid mature region (see SEQ ID NOS:61 and 62 and GenBank Accession No. P07711). Cathepsin L also includes allelic and species variants, and other variants. Exemplary of such variants are any set forth in SEQ ID NOS:208 to 223 and 234. Cathepsin L is synthesized as an inactive proenzyme, and like other proteases, contains a propeptide corresponding to amino acids 18-113 of the sequence of amino acids set forth in SEQ ID NO:62. The propeptide inhibits the proteolytic activity of the enzyme. The propeptide segment also functions to stabilize the proenzyme from the denaturing effects of neutral to alkaline pH (Coulombe et al. (1996) The EMBO J., 15:5492-5503). Cleavage of the propeptide occurs by autoprocessing under acidic conditions resulting in a mature enzyme that is active and has catalytic activity under acidic conditions. The mature cathepsin L (set forth in SEQ ID NO:1) can exist as a single chain form of about 28 kDa and/or as a two-chain form of about 24 and 4 kDa (heavy and light chain, respectively). Allelic and species variants of cathepsin L are known. Exemplary species variants are any set forth in SEQ ID NOS:208-223, including nucleic acids and encoded polypeptide and mature forms thereof lacking the signal sequence and propeptide. Exemplary allelic variants are any set forth in SEQ ID NO:234.

Cathepsin L is primarily localized to endosomes and lysosomes. The optimal proteolytic capacity of mature cathepsin L is achieved at an acidic pH of about 5.5, and it is inactive at neutral pH (Bohley P et al., "Intracellular Protein Turnover." in S. Holzer and H. Tschcsche (eds.). *Biological Functions of Proteinases*, pp. 17-34, Berlin: Springer-Verlag. 1979). The pH optima of cathepsin L can be influenced by ionic strength, and therefore the pH optima differs between buffers (Dehrmann et al. (1995) *Arch. Biochem. Biophys.*, 324: 93-98). Procathepsin L is stable under neutral and slightly alkaline pH, conditions where mature cathepsin L is inactivated (Jerala et al. (1998) *J. Biol. Chem.*, 273:11498-11504). For example, at acidic pH the enzyme is more stable, acts less on itself, but actively catalyzes hydrolysis of protein substrates. At pH closer to neutral or physiologic pH and in the presence of elevated temperature such as 37° C., the enzyme is highly unstable because it prefers itself as a substrate (autocatalysis) versus other protein substrates. A reducing agent, if added to an active cathepsin L, can enchance these activities both at acidic and physiologic pH.

The activated form of cathepsin L has seven half cysteine residues, which include three disulfinde cysteins and 1 free cysteine (the active site Cys 25 that is conserved in the cysteine protease family). The presence of a reduced sulfhydryl group (-SH) of the Cys25 is required for activity. Hence, the presence of a reducing agent such as Cysteine or a reduced form of glutathioe can help keep the active site sulfhydryl in the reduced state. Alternately, or in addition, the reducing agent can reduce the disulfides and help attain a more favorable protein conformation (secondary and tertiary) that induces better binding and catalysis of in vivo substrates.

Cathepsin L degrades proteins substrates, including, but not limited to, collagen, IL-8 precursor, neurotransmitter precursor, pro-enkephalin, and immunoglobulin light chain-associated (AL) amyloid deposits and azocasein (Barret & Kirschke (1981) Methods Enzymol., 80:535-561; Mason et al., (1985) Biochem. J., 226:233-241). CatL is rapidly inhibited by Z-Phe-Ala-CHN2.

ii. Calpain

Calpain is a $Ca^{2+}$-dependent cytoplasmic cysteine protease that exists in two predominant forms, µ-calpain (calpain 1) and m-calpain (calpain 2). Calpain substrates include cytoskeletal proteins, signal-transducing enzymes, transcriptional regulatory factors and integral membrane proteins. Among ECM components, calpains degrade fibronectin, vitronectin and proteoglycans (Ian M. Clark and Gillian Murphy. "Matrix Proteinases," in Dynamics of Bone and Cartilage Metabolism, Academic Press (2006), pp. 181-198).

Calpains exist as inactive heterodimers (and ~80 kDa and ~30 kDa subunits), and require $Ca^{2+}$ for autocatalysis. µ-calpain and m-calpain differ in their sensitivity to $Ca^{2+}$ required for activation; µ-calpain is half-maximally activated at low micromolar calcium concentrations, which is about an order of magnitude lower than those concentrations required to activate m-calpain (Meyer et al. (1996) Biochem. J, 314:511-519). Upon activation, both subunits of calpain undergo limited autolysis that removes the N-terminal prosegment and increases calcium sensitivity. Autolysis itself is not sufficient to activate calpain because the autolyzed protease still requires calcium to cleave substrate (Meyer et al. (1996) *Biochem. J*, 314:511-519). Thus, sustained activation of calpain requires the presence of calcium. The calcium requirements are considerably higher than physiological $Ca^{2+}$ concentrations, which is generally 1 µM. For example, in vitro µ-calpain requires a calcium concentration of 10-50 µM and m-calpain requires a calcium concentration of 300-500 µM (Hosfield et al. (1999) *The EMBO J.*, 18:6880-6889). Due to the calcium requirement, calpain is regulated by regional calcium fluxes and/or membrane binding (Molinari and Carafoli (1997) *J Membr. Biol.*, 43:543-5.) Calcium likely induces a conformation change to expose the active site of the protease. Calpastatin is a specific cellular inhibitor of calpains.

c. Aspartic Proteases

Aspartate proteases include some proteases found in lysosomes that have been shown to degrade ECM components. Included among these are cathepsins D and E. For activity, two aspartate residues participate in acid/base catalysis at the active site. In the initial reaction, one aspartate accepts a proton from an active site $H_2O$, which attacks the carbonyl carbon of the peptide linkage. Simultaneously, the other aspartate donates a proton to the oxygen of the peptide carbonyl group.

The zymogen form of aspartate proteases contain a positively charged N-terminal prosegment that interacts with the central portion of the enzyme forming salt-bridges with the negatively charged segment. Due to the positioning of the prosegment and the formation of the salt bridges, substrates are prevented from accessing the active site. Zymogen conversion to an active enzyme occurs by disruption of the salt bridges at low pH. Exposure to low pH results in protonation of the carboxylate side chains of Asp and Glu residues, resulting in destabilization of salt bridges between the prosegment and mature enzyme. Once removed, the prosegment is autocatalytically degraded by the active enzyme. Subsequent hydrolysis of the prosegment ensures that activation is irreversible, and that the released prosegment will not act as a competitive inhibitor of the active enzyme. Further, no other accessory molecules are required for conversion (Khan et al. (1998) *Protein Science*, 7:815-836). Like cathepsins of the cysteine protease family, however, acidic pH conditions are required for activity and stability of the mature enzymes.

d. Metalloproteases

Metalloproteases (also called Zinc proteases) include the digestive enzymes carboxypeptidases, various matrix metalloproteases (MMPs) that are secreted by cells, ADAMs (a disintegrin and metalloprotease domain), ADAMTS (a disintegrin and a metalloproteinase domain with thrombospondin motifs) and lysosomal proteases. These enzymes, including ADAMs and MMPs, have roles in embryonic development, cell growth and proliferation, inflammatory responses, wound repair, multiple sclerosis, arthritis, and cancer progression and metastasis (Manzetti et al., (2003) *J of Computer-Aided Mol. Design*, 17: 551). Most MMPs (e.g., collagenase) are involved in degradation of the extracellular matrix, for example, during tissue remodeling. For example, many of these enzymes can cleave components of the basement membrane and extracellular matrix.

Metalloproteases contain a $Zn^{++}$ ion at the active center of the enzyme required for catalytic activity. A zinc binding motif at the active site of a metalloprotease includes two histidine residues whose imidazole side-chains are ligands to the $Zn^{++}$. During catalysis, the $Zn^{++}$ promotes nucleophilic attack on the carbonyl carbon by the oxygen atom of a water molecule at the active site. An active site base (a glutamate residue in carboxypeptidase) facilitates this reaction by extracting a proton from the attacking water molecule. Generally, these enzymes have a common zinc binding motif (HexxHxxGxxH; SEQ ID NO: 538) in their active site, and a conserved methionine turn following the active site. Mutation of any one of the histidines ablates catalytic activity.

The zymogen form of metalloproteases contains a prosegment of about 80-100 residues in length. In the zymogen form, the residues within the substrate binding site of the mature enzyme and the catalytic $Zn^{++}$ ions are in the same conformational position as in the active form, and do not change upon zymogen conversion. The enzyme is inactive because the prosegment is positioned to block the site, thus preventing access to substrates. Conversion of the zymogen to the active enzyme results from cleavage of the prosegment from the mature enzyme. Multiple mechanisms are capable of initiating cleavage events, including actions by other proteases, heat, mercurial agents (e.g., 4-amino-phenylmercuric acetate), SH-reactive agents, reactive oxygen and detergents (see e.g., Khan et al. (1998) *Protein Science*, 7:815-836; Okada et al. (1988) *Biochem J.*, 254:731-741; Okada & Nakanashi (1989) *FEBS Lett.*, 249:353-356; Nagase et al. (1990) *Biochemistry*, 29:5783-5789; Koklitis et al. (1991) *Biochem J.*, 276:217-221; Springman et al. (1990) *PNAS*, 87:364-8; Murphy et al. (1997) *Matrix Biol.*, 15:511-8).

e. Heparanase

Heparanase is a glycosylated enzyme that is involved in the catabolism of certain glycosaminoglycans. It is an endo-β-glucuronidase that cleaves heparan sulfate at specific intrachain sites. Heparanase is a member of the glycosyl hydrolase clan A (GH-A), which share a common catalytic mechanism that involves two conserved acidic residues, a putative proton donor at $Glu^{225}$ and a nucleophile at $Glu^{343}$ (Hulett et al. (2000) *Biochemistry*, 39:15659-15667). Interaction of T and B lymphocytes, platelets, granulocytes, macrophages and mast cells with the subendothelial extracellular matrix (ECM) is associated with degradation of heparan sulfate by heparanase activity.

Human heparanase cDNA encodes a protein that is initially synthesized as a pre-pro-protein with a signal peptide sequence that is removed by signal peptidase upon translocation into the endoplasmic reticulum (ER). The resulting 65 kDa pro-enzyme form is further processed by proteolytic cleavage resulting in excision of an intervening 6 kDa fragment generating an 8 kDa polypeptide and a 50 kDa polypeptide, forming a heterodimer. The sequence of amino acids of the mature heparanase is set forth in SEQ ID NO:156. Heparanase activity and localization is tightly regulated. For example, the enzyme is highly sensitive to changes in local pH, exerting a high enzymatic activity under acidic conditions that exists in the vicinity of tumors and in inflammatory sites with little or no activity at physiological pH. Thus, heparanase-mediated cleavage of the HS scaffold is a pH-dependent process; maximal enzymatic activity is achieved at pH values ranging from 4 to 6.8 (Gilat et al. (1995) *J Exp. Med.*, 181:1929-1934; Goldshmidt et al. (2003) *The FASEB J.*, 17:1015-1025). At physiological pH, heparanase exhibits little activity. The pH-dependence ensures that the structural breakdown of the ECM is confined to more acidic conditions, such as occurs in endosome and at sites of injury or inflammation (McKenzie et al. (2003) *Biochem. J*, 373:423-435).

D. Activatable Matrix-Degrading Enzymes (AMDE)

Matrix-degrading enzymes require zymogen conversion for activation by cleavage of the prosegment to generate a mature enzyme. As discussed above, many matrix-degrading enzymes also require the continued presence of one or more other activating conditions for activity. Exemplary of such activating conditions include, but are not limited to, pH, metal ions, temperature, reducing agents, oxidizing agents and salt concentration. For example, many enzymes require specific pH values or metal ion concentration or salt concentration or the presence of a reducing agent for activity. In one example, lysosomal enzymes require acidic pH conditions for activity. For example, cathepsins of the cysteine and aspartic family of proteases require acidic pH conditions for activity. Heparanase also is a lysosomal enzyme that accumulates in lysosomes for normal processing in the acidic environment. Generally, the acidic environment is provided in the acidic lysosomes where lysosomal proteases are normally localized. Outside of this environment, lysosomal proteases are inactive or less active and require exogenous exposure to acidic pH for activity. In another example, an activating conditions include metal ion concentration. For example, the calpains require sufficient concentration of $Ca^{2+}$ for activity. Activity of such enzymes is reversible in the absence of the activating condition.

By taking advantage of the requirement for exogenous activating conditions, activatable matrix-degrading enzymes can be made temporally active for a limited duration upon in vivo administration, for example to the ECM. Such activatable matrix-degrading enzymes are active only when exposed to exogenous activating conditions. Since the activating condition is not present at the site of administration and must be applied exogenously, the activating condition will become neutralized or dissipate over time after in vivo administration of an activator supplying the appropriate activating condition. Hence, activation of an AMDE is reversible following in vivo administration as the activator dissipates or is otherwise neutralized. For example, temporal activation of an AMDE can be achieved in the environment of the interstitium of the skin and other tissues by administering the AMDE in the presence of an exogenous activating condition (i.e. an activator) that is not present at the site of administration. Typically, the activating condition is one that is not present in the ECM, prior to administration of an activator providing the activating condition. Thus, exposure of an activatable matrix-degrading enzyme to an activating condition results in enzyme activation for a limited or predetermined time as the activating condition dissipates or is neutralized in the interstitial environment.

Hence, provided herein are compositions, combinations and containers containing activatable matrix-degrading enzymes that, upon in vivo administration, permit activation of the enzyme for a limited or predetermined period of time during which the enzyme can exert its biological action. By virtue of the reversible activity of the activatable enzymes, the enzymes become deactivated, thereby controlling the duration of the biological action of such enzymes. The activatable matrix-degrading enzymes are provided in combinations and containers with an activator that provides the activating condition. In addition, the activatable matrix-degrading enzyme and activator also can be combined or provided in combination, such as in containers, with other agents such as any one or more of an antsthetic, alpha adrenergic agent or dispersing agent. The activatable matrix-degrading enzymes are provided in a therapeutically effective amount, that when activated, degrade one or more components of the ECM upon administration, such as upon subcutaneous administration. The resulting activatable matrix-degrading enzymes can be used as therapeutics to treat ECM-mediated diseases or conditions.

Any matrix-degrading enzyme, whether synthetic or isolated from natural sources, such as those set forth in Table 3 or elsewhere herein, allelic or species variants or other variants thereof, or any known to those of skill in the art is intended for use in the compositions, combinations, methods and apparatus provided herein, so long as the enzyme is activatable due to the requirement of an activating condition. The activatable matrix-degrading enzymes are provided in an inactive form either as a zymogen or as an inactive mature polypeptide either in single-chain or two-chain form.

For example, cathepsins even in their mature form are inactive and require acidic pH conditions for conformational stability. Activatable matrix-degrading enzymes include lysosomal proteases, such as cathepsins of the cysteine and aspartic family and heparanases. Exemplary activatable matrix-degrading enzymes are any set forth in any of SEQ ID NOS:56, 59, 62, 64, 179, 67, 70, 73, 76, 182, 185, 188, 79, 194, 89, 92, 95 and 155 and mature forms thereof set forth in SEQ ID NOS:57, 60, 1, 65, 180, 68, 71, 74, 77, 183, 186, 189, 80, 195, 90, 93, 96 and 156 or allelic variants or species variants or other variants thereof. One of skill in the art knows or could identify activatable matrix-degrading enzymes. For example, one of skill in the art could use routine assays of enzyme activation, such as any provided herein and known in the art, to assess the requirement of an exogenous activating condition for sustained or reversible activation of any desired enzyme.

Activatable matrix-degrading enzymes can be modified to alter any one or more properties or activities. For example, altered properties or activities include, but are not limited to, modification that render the enzyme more stable, alter the substrate specificity and/or confer temperature sensitivity to the enzyme. If desired, enzyme stability also can be increased by pegylation or glycosylation of the enzyme. Modification of polypeptides using standard recombinant DNA techniques is routine to one skilled in the art. For purposes herein, modified matrix-degrading enzymes retain one or more activities of the unmodified enzyme and are activatable. Retained activity can be 40%, 50%, 60%, 70%, 80%, 90%, 95% or more activity of the unmodified enzyme.

In one example, a matrix-degrading enzyme, for example, a cathepsin, can be modified such that its prosegment is not inhibitory. Modifications can be made by amino acid replacement, substitution or insertion within the prosegment itself, or within regions of the active site where the inhibitory interactions occur. Hence, a cathepsin could be provided in a zymogen form where autocatalysis occurs under acidic conditions; the cleaved prosegment of such a modified enzyme would not result in inactivation as occurs for wild-type cathepsins if provided in a zymogen form.

In another example, an activatable enzyme can be modified to alter its substrate specificity. For example, an enzyme can be modified to have increased specificity for a particular substrate. Thus, for example, cathepsin L, which exhibits substrate specificity for type I and type IV collagen can be modified so that it has increased substrate specificity for type I collagen, and not type IV collagen, and vice versa. Modifications of polypeptides can be achieved by routine molecular biology techniques, and are within the skill of one in the art. Modified enzymes can be tested for their substrate specificity using routine assays for substrate cleavage such as is described herein, or known in the art. For example, substrate cleavage can be assessed on fluorogenic peptides or on purified proteins. Cleavage can be assessed using in vitro or in vivo assays. For example, cleavage can be assessed by incubating the enzyme with the substrate, and then running the mixture on an SDS-PAGE gel. Degradation can be assessed by Western Blot or by using standard protein stains such as Coomasie Blue or Silver Stain reagents.

In an additional example, a matrix-degrading enzyme can be modified to have temperature sensitivity. For example, matrix-degrading enzymes that are active at physiological temperature (e.g. 37° C.) can be modified and enzymes selected that are active at lower temperatures (e.g., less than 37° C.; e.g. at or about 20° C., 21° C., 22° C., 23° C., 24° C., 25° C., 26° C., 27° C., 28° C., 29° C. or 30° C.), but that are not active at physiological temperature. Hence, such modified enzymes can be used as activatable matrix-degrading enzymes where the activation condition is low temperature. Administration of the enzymes simultaneously, intermittently, or subsequently with an activating condition providing the cold temperature (e.g. cold buffer) results in activation of the enzyme. The activation of the enzyme is temporally controlled as the in vivo temperature returns to the physiological temperature of 37° C.

1. Activating Conditions and Methods for Activation of Activatable Matrix-Degrading Enzymes Activatable matrix-degrading enzymes are inactive in the absence of an activating condition. Upon in vivo administration, temporal activation of such activatable matrix-degrading enzymes is achieved by exposure (prior to or upon administration subsequently, intermittently or simultaneously) to one or more specific activators that provide an activating condition sufficient for activation of the enzyme. For example, activation can be achieved by exposure of activatable matrix-degrading enzymes to, for example, temperature (e.g. heat or cold), pH, salt, to solutions containing sufficient concentrations of metal ions (e.g., $Ca^{2+}$) for activation, to solutions containing sufficient concentrations of reducing agents or oxidizing agents for activation, or other methods as described herein or known to one of skill in the art. The choice of activator will vary depending upon the choice of enzyme as described herein or known to one of skill in the art. Generally, an amount (e.g. concentration, level or degree) of activator sufficient to generate an active enzyme is used. This amount can be readily determined empirically and is dependent upon the selected enzyme and selected application.

By virtue of the reversible and conditional activation of activatable enzymes, temporary activation is achieved, thereby regulating the duration of enzymatic action on extracellular matrix (ECM) components. This is an advantage of the present methods such that deleterious side effects associated with unwanted prolonged activation of enzymes can be controlled. Temporary activation is achieved because activatable matrix-degrading enzymes require continuous exposure to activating conditions in order to remain active. Activating conditions are not normally present, endogenously, in sufficient amounts for activation of an enzyme at sites where activatable matrix degrading enzymes are administered in vivo. For example, the skin interstitium has a neutral pH, and thus a low pH activating condition is not normally present. In another example, the physiological level of metal ions, such as calcium, in the skin interstitium, are far lower than the effective amounts required for activation of some enzymes. Thus, deactivation of enzymes can occur upon decreasing exposure of the enzyme to the exogenous activating condition as may occur following in vivo administration of an activatable enzyme where the exogenously supplied activating condition gradually dissipates or is neutralized.

Thus, activating conditions provided herein are those which are required for activation of an activatable matrix-degrading enzymes, but that are not normally present in sufficient amounts at the site of administration. The requirement for activating conditions for activation of activatable matrix-degrading enzymes permits activation of matrix-degrading enzymes for a limited time, until the activating condition dissipates or is neutralized such that the enzyme becomes inactive or becomes unstable and is degraded. The amount of time an enzyme is active can be for a predetermined time. For example, an activator can be provided containing an amount of activating condition, such as the concentration, effective amount, level or degree, that is chosen such that the enzyme is active for a set time under the environment and conditions it is exposed to upon in vivo administration. In one example, where acidic pH is the activating condition, the buffering capacity of an acidic buffer can be adjusted to modulate the time of its resistance to changes in pH. The predetermined time at which an activator activates a conditionally activatable matrix-degrading enzyme can be determined empirically and is a function of the disease to be treated, the individual treated, the choice of enzyme and the activator. An activatable matrix-degrading enzyme can be active following in vivo administration in the presence of an activator providing an activating condition for at or about 1 minute, 2 minutes, 3 minutes, 4 minutes, 5 minutes, 10 minutes, 20 minutes, 30 minutes, 40 minutes, 50 minutes, 1 hour, 2 hours, 3 hours, 4 hours, 5 hours, 6 hours or more.

Exemplary activating conditions and activators and methods of temporal activation are described herein below. In view of such description, other embodiments will be apparent to one of skill in the art.

a. Activating Condition—Acidic pH

Compositions and methods for conditional activation of matrix-degrading enzymes whose activity is regulated by pH, and use of such enzymes to treat ECM-mediated diseases or conditions are provided herein. Such methods take advantage of proteins having enzymatic activity only at acidic pH, while remaining inactive or becoming unstable and degraded at neutral pH. Such proteins include lysosomal proteases, including, but not limited to, cathepsins of the cysteine and aspartic families, and also heparanase. For example, lysosomes, an acidic intracellular compartment, contain a large variety of hydrolytic enzymes that degrade proteins and other substances internalized by endocytosis. All intralysosomal proteases, for example, cathepsin L, exhibit an acid pH optimum. Exemplary of such proteases are any set forth in any of SEQ ID NOS:57, 60, 1, 65, 180, 68, 71, 74, 77, 183, 186, 189, 80, 195, 90, 93, 96 and 156.

Methods of using matrix-degrading enzymes that are active only upon exposure to certain pH conditions are used herein to take advantage of pH differentials within the skin. Human epidermal systems maintain a pH gradient within the stratified layers of the skin. The outer layers have been reported to exhibit an average pH of 5.5 (W. P. Smith (1994) *Cosmetics and Toiletries,* 109:41-48). The pH of successive layers of the epidermis increases with depth, reaching a final pH closer to the physiological range (about pH 7.4) at the dermal layer.

Hence, it is contemplated herein that activatable matrix-degrading enzymes are employed that exhibit activity at acidic conditions, but are substantially inactive at neutral pH such as exists in the ECM. A substantially inactive enzyme is any exhibiting 10% or less activity of the enzyme at its pH optima, for example, at or about 1%, 2%, 3%, 4%, 5%, 6%, 7%, 8%, 9%, 9.5% or 10% of activity as present at the enzyme's pH optima. One of skill in the art knows or can determine the pH optima of an enzyme and can assess activity differences at varying pH conditions. For example, the pH optima of cathepsin L is or is about 5.5, but can vary within a range of 4.5 to 6 depending on the particular species of cathepsin L, buffer condition or ionic strength. Cathepsin L is substantially inactive at or above pH 7.4 (Dehrmann et al. (1995) *Arch. Biochem. Biophys.,* 324:93-98). In another example, the optimal pH value for the activity of cathepsin D is or is about 3.0 to 4.0, and it is substantially inactive at pH values at or about 6.0 or higher (Rojas-Espinosa et al. (1973) Infection and Immunity, 8:1000-1008). Cathepsin S is one of the few lysosomal proteases that is stable at pH 7.0 (Bromme et al. (1993) J Biol. Chem., 268: 4832-4838).

For purposes herein, an activatable enzyme is active in pH conditions at or about 3, 3.5, 4, 4.5, 5, 5.5, 6 or 6.5, but is substantially inactive at neutral pH. A pH activity profile can be performed on an enzyme, and relative activity assessed, to determine its pH optima under various conditions (Dehrmann et al. (1995) *Arch. Biochem. Biophys.,* 324:93-98). It is understood that pH optima can be different depending on the substrate used, buffer conditions, ionic strength and species of enzyme. Thus, reference to pH optima herein is for exemplification only. One of skill in the art can empirically determine the pH optima of an enzyme under specific conditions. For example, buffer conditions and ionic strengths can be varied to determine an enzymes activity under various pH conditions. Enzyme assays to determine pH-activity profiles can be performed using fluorogenic substrates such as are described herein and known to one of skill in the art. The choice of fluorogenic substrate used will vary between enzymes, and is known to one of skill in the art or can be empirically determined.

Thus, the ability to conditionally activate matrix-degrading enzymes by administration with an activating condition not normally present at the site of administration permits the temporal regulation of, and alteration of, the physiological parameters of organs and tissues, such as the interstitium, exhibiting a neutral pH. Under normal physiological conditions, the pH of the interstitium is neutral. Thus, activatable matrix-degrading enzymes active at low pH, such as lysosomal enzymes described herein, when present in the interstitium would normally be catalytically inactive because of the neutral pH of the interstitium. When the pH of the interstitium is temporarily rendered acidic, for example by administration of a buffered acid solution, lysosomal enzymes with optimal acidic pH when administered to the interstitium will become activated. When the pH of the intersitium turns back towards neutrality, then the matrix-degrading enzymes with requiring acidic pH become inactivated and cease to exert their enzymatic activity.

Accordingly, it is contemplated herein that activatable matrix degrading enzymes that are substantially inactive at neutral pH can be administered sub-epidermally under the skin (i.e. by subcutaneous, intradermal or intramuscular administration) where the pH is neutral. Other routes of administration of conditionally activatable matrix-degrading enzymes also are contemplated and can be empirically determined based on the pH optima of the particular enzyme such that the activity of the enzyme becomes reversible due to changes in the pH conditions upon administration. Other routes of administration include, but are not limited to, oral, topical and transdermal routes of administration.

Since the interstitium of most tissues and organs exhibits a neutral pH, temporary acidification can be achieved by infusing an acidic solution to a tissue or organ interstitium. The acidic buffer is a composition that, when administered, temporarily lowers the pH of the interstitium to less than or about 3.0, 3.5, 4.0, 4.5, 5.0, 5.5, 6.0 or 6.5 such that the activatable matrix-degrading enzyme is active. The acid component of the buffer is susceptible to neutralization by the neutral pH of the interstitium. Acidic buffers are known to one of skill in the art. For purposes herein, the acid component of the buffer can be an organic or inorganic acid. Generally, the solution is a solution of a weak acid. Exemplary acids include, but are not limited to, 2-(N-morpholino) ethanesulfonic acid) (MES), acetic acid, citric acid, succinic acid, lactic acid, maleic acid, glycine-hydrochloric acid, citric phosphate and histidine. The effective pH range of acidic buffers is known, and hence, appropriate buffers can be chosen based on the pH optima of the selected enzyme. Exemplary of acidic buffers include, but are not limited to, acetate, citrate, formate, glycine, malate, MES, phosphate, piperazine, propionate, pyridine and succinate buffer. For example, the effective pH range of MES buffer is 5.5 to 6.7.

The time period required for neutralization, and subsequent inactivation of the acid activatable matrix-degrading enzyme, depends on the formulation of the acidic buffer. For example, shorter time periods result if the acid and/or buffering agents in the acidic buffer are weak relative to the neutralizing capacity of the interstitium; longer time periods result if a stronger acid is utilized or a stronger buffering agent is employed in the acidic buffer. Hence, the resistance to change in pH is dependent on the buffering capacity of the particular buffer. The higher the ionic strength or concentration of the buffer, the higher the buffer capacity. Thus, in the methods and compositions provided herein, temporal regulation of a matrix-degrading enzyme activated at a given pH can be further controlled by the buffering capacity of the buffer chosen. This is exemplified in Example 7. Determination of desired buffers for given applications is routine and within the level of one of skill in the art.

Typically, the acidic solution is infused directly to a site where degradation of one or more ECM components is desired, for example, to treat an ECM-mediated disease or condition. The infusion of the activating condition in the form of an acidic solution activator can be performed simultaneously, sequentially or intermittently with administration of an inactive activatable matrix-degrading enzyme. Where administration occurs simultaneously, the activatable matrix-degrading enzyme and buffered acidic solution can be in the same or separate compositions. When in the same composition, the enzyme and buffered acidic solution can be provided in a composition as a mixture. Activation of the enzyme also can be achieved by addition of the acidic solution to a concentrated liquid solution or suspension or lyophilized or powdered form of the enzyme prior to administration. Generally, where a liquid solution or suspension of an activatable matrix-degrading enzyme is provided, it is a solution or suspension that, when exposed to an activator providing the appropriate activating condition, is amenable to activation of the enzyme by the activating condition.

In addition, in the combinations and methods provided herein, an activator having the activating condition (e.g. a buffered acidic solution) and an activatable matrix-degrading enzyme can be provided and administered in combination with any one or more other agents such as any one or more of an anesthetic, alpha adrenergic receptor agonist or dispersing agent. Exemplary of such agents are discussed herein below in the Section entitled "Combination Therapies." The other agents can be administered simultaneously, sequentially or intermittently with the activator and/or matrix-degrading enzyme.

In one example of the methods provided herein, a buffered acid solution is administered into the skin interstitium, or other tissue, where an ECM condition or disease is present. The buffered acidic solution can be chosen based on the pH required for activation of the a matrix-degrading enzyme and the desired buffering capacity to achieve activation of limited duration. For example, cathepsin L is an exemplary enzyme for purposes of treating a collagen-mediated disease, such as, for example cellulite. Accordingly, the acidic buffer would be prepared at the optimum pH of 5.5 for activation of cathepsin L. Exemplary of such an acidic buffer is MES. The buffering capacity of the acidic solution also can be experimentally determined as desired, for example, as set forth in Example 7. Generally, the acidic buffer is administered just prior to or together with the matrix-degrading enzyme. For example, if the matrix-degrading enzyme is provided in lyophilized form, the enzyme can be reconstituted with the acidic buffered solution just prior to administration, and the combination of the enzyme and activator administered together. In the presence of the acidic buffer, the enzyme is activated following in vivo administration. Depending on the buffering capacity of the acidic buffer, the pH of the interstitium will return to neutrality after a limited or predetermined time, thereby reversing the degradative effects of the matrix-degrading enzyme.

In another example of the methods provided herein, a combination of a anesthetic and vasoconstrictor, for example, lidocaine/epinephrine, is administered prior to administration of the activator and matrix-degrading enzyme. Generally, in the methods, a dispersing agent, such as a hyaluronan degrading enzyme, for example a hyaluronidase, also is administered together with the anesthetic and vasoconstrictor, such as an alpha adrenergic receptor agonist.

b. Activating Condition—Metal Cation Concentration

Provided herein are composition, combinations, containers and methods containing activatable matrix-degrading enzymes that require exposure to a suitable metal ion, for example $Ca^{2+}$, $Mg^{2+}$ or $Zn^{2+}$, for activation. Exemplary of such an enzyme is calpain (e.g. large subunit set forth in SEQ ID NO:82 (calpain 1) and SEQ ID NO:85 (calpain 2) and small subunit set forth in SEQ ID NO:87, or allelic or species variants or other variants thereof), which requires $Ca^{2+}$ for activation. The metal ion can be provided in the form of an aqueous composition, for example, as a calcium salt. The inactive enzyme can be provided as a mixture with a metal ion, or can be provided as a separate composition. If provided as a separate composition, such as in the form of a concentrated liquid composition or in lyophilized or powdered form, addition of the metal ion to the enzyme will result in an activated enzyme.

Generally, activation is achieved by exposing an inactive enzyme to a metal cation, for example $Ca^{2+}$, at a concentration sufficient for activation. Precise amounts can be empirically determined or are known to those of skill in the art. For example, in vitro activation of µ-calpain and m-calpain require 10-50 and 300-500 µM calcium concentrations, respectively (Hosfield et al. (1999) *The EMBO J.*, 18: 6880-6889.) Assays for enzymatic activity can be performed to determine optimal concentrations. Typically, for purposes herein, activatable matrix-degrading enzymes include those that require sufficient concentration of a metal ion for activation at a concentration that exceeds the physiological level of metal ion present in the interstitium. For the case of µ-calpain and m-calpain, the calcium levels required for activation exceed physiological levels (see e.g., U.S. Pat. No. 6,620,592; Hosfield et al. (1999) *The EMBO J.*, 18: 6880-6889.)

In general, the inactive enzyme is packaged or provided so that there are insufficient metal ions to trigger enzyme activation. Hence, where the inactive enzyme is provided as a composition separate from the metal ion activator, it might be necessary to add ethylenediaminetetraacetic acid (EDTA) or ethylene glycol tetraacetic acid (EGTA) (concentrations from about 5 to about 100 mM or higher depending on the application) to tie up any $Ca^{2+}$ or other metal ion to prevent triggering the activation reaction until desired. The activation reaction then can be triggered by adding $Ca^{2+}$ (or other metal cation) at a concentration sufficient to overcome the effects of the chelator. Precise amounts can be empirically determined.

Depending on the enzyme, temporary activation can be achieved simply by discontinued exposure to metal ion. For example, sustained activation of calpain requires the presence of calcium. Thus, an inactive form of calpain can be activated by adding $Ca^{2+}$, and the resulting mixture, either in the same or separate compositions, can be administered to the interstitum of an organ or tissue. Upon administration, however, the effective concentration of calcium required for continued activation is no longer available; the resulting active enzyme will ultimately return to its inactive state. In other examples, the temporal regulation of an enzyme requiring a metal ion for activation can be controlled by administration of a metal chelator or other reversing agent.

c. Activating Condition—Reducing Agent

Provided herein are composition, combinations, containers and methods containing activatable matrix-degrading enzymes that require exposure to a suitable thiol or non-thiol containing reducing agent, for example, tris(2-carboxyethyl) phosphine (TCEP) or cysteine, for activation. Exemplary of such an enzyme is cathepsin L, which requires reducing agent for activation. The reducing agent can be provided in the form of an aqueous composition, for example, as cysteine. The inactive enzyme can be provided as a mixture with a reducing agent, or can be provided as a separate composition. If provided as a separate composition, such as in the form of a concentrated liquid composition or in lyophilized or powdered form, addition of the reducing agent to the enzyme will result in an activated enzyme. The reducing agent can be added prior to, simultaneously, subsequently or intermittently upon administration of the enzyme.

Generally, activation is achieved by exposing an inactive enzyme to a reducing agent, for example cysteine, at a concentration sufficient for activation. Precise amounts can be empirically determined or are known to those of skill in the art. For example, in vitro activation of cathepsin L generally requires 1-50 mM cysteine. Assays for enzymatic activity can be performed to determine optimal concentrations. Typically, for purposes herein, activatable matrix-degrading enzymes include those that require sufficient concentration of a reducing agent for activation at a concentration that exceeds the physiological level of reducing agent present in the interstitium.

In general, the inactive enzyme is packaged or provided so that there is insufficient reducing agent concentration to trigger enzyme activation. The activation reaction then can be triggered by adding cysteine (or other reducing agent) at a concentration sufficient to recover enzyme activity. Precise amounts can be empirically determined.

Depending on the enzyme, temporary activation can be achieved simply by discontinued exposure to reducing agent. For example, sustained activation of cathepsin L requires the presence of cysteine or TCEP. Thus, an inactive form of cathepsin L free of its prosegment can be activated by adding cysteine, and the resulting mixture, either in the same or separate compositions, can be administered to the interstitium of an organ or tissue. Upon administration, however, the effective concentration of cysteine required for continued activation is no longer available; the resulting active enzyme will ultimately return to its inactive state. In other examples, the temporal regulation of an enzyme requiring a reducing agent for activation can be controlled by administration of a reversing agent such as oxidized glutathione.

d. Activating Condition—Temperature

Provided herein are temperature sensitive (ts) enzyme mutants of matrix-degrading enzymes (tsAMDE) that degrade one or more components of the extracellular matrix (ECM) in a temperature-dependent manner. In particular, mutants provided herein degrade a collagen. In some examples, the mutants display higher activity at lower temperatures (e.g. 25° C.) then at higher temperatures, for example, physiologic temperatures (e.g. 37° C.). In other examples, the mutants display higher activity at physiologic temperatures then at lower temperatures. Thus, the activation of the tsAMDE, for example, tsMMPs, upon administration to the body, can be temporally and conditionally controlled by virtue of changes in temperature. Uncontrolled enzyme activity can be highly disruptive to tissue integrity. By virtue of the conditional activation of activatable tsAMDE, temporary activation is achieved, thereby regulating the duration of enzymatic action on extracellular matrix (ECM) components to reduce deleterious side effects associated with unwanted prolonged activation of enzymes. This is an advantage of the present tsAMDE, for example tsMMPs, over existing collagenase treatments for treating ECM-mediated diseases or conditions. Hence, an advantage of such mutants is that their activity can be regulated, thereby permitting the use of tsAMDE to treat diseases and/or conditions of the ECM.

tsAMDEs mutants, for example tsMMPs, provided herein include those that are modified to be temperature sensitive, for example, by amino acid substitution, insertion or replacement. Generally, tsAMDEs contain one or more amino acid replacements in their primary sequence rendering the protein more active at permissive temperatures then at non-permissive temperatures. tsAMDEs provided herein can contain 1, 2, 3, 4, 5, 6, 7, 8, 9, 10, 11, 12, 13, 14, 15, 16, 17, 18, 19, 20 or more amino acid modifications. In particular, tsAMDEs provided herein contain 1, 2, 3, 4, 5, 6, 7, 8, 9 or 10 amino acids modifications.

tsAMDEs, for example tsMMPs, provided herein are activatable at a permissive temperature, but are less active or inactive at other non-permissive temperatures. The tsAMDEs provided herein have a ratio of activity at a permissive temperature compared to a non-permissive temperature that is or is about 1.1, 1.2, 1.3, 1.4, 1.5, 1.6, 1.7, 1.8, 1.9, 2.0, 2.5, 3.0, 3.5, 4.0, 4.5, 5, 5.5, 6, 6.5, 7, 7.5, 8, 8.5, 9, 9.5, 10, 15, 20, 30, 40, 50 or more. Thus, the activity of the tsAMDEs provided herein at the non-permissive temperature is or is about 70%, 65%, 60%, 55%, 50%, 45%, 40%, 35%, 30%, 25%, 20%, 15%, 10%, 5%, 4%, 3%, 2%, 1%, 0.5% or less of the activity at a permissive temperature.

For example, AMDEs that are normally active at physiological temperature (e.g. 37° C.) are modified and enzymes selected that are active at lower temperatures (e.g. less than 37° C.; e.g. at or about 20° C., 21° C., 22° C., 23° C., 24° C., 25° C., 26° C., 27° C., 28° C., 29° C. or 30° C.), but that are less active or inactive at physiologic temperature. Such modified enzymes can be used as activatable matrix-degrading enzymes (AMDE) where the activation condition is low temperature. The activation of the enzyme is temporally controlled as the in vivo temperature returns to the physiological temperature of 37° C. Thus, for example, tsAMDEs provided herein are active at a permissive temperature that is at or about 25° C., but are less active at higher temperatures such as at or about 33° C., 34° C., 35° C., 36° C., 37° C., 38° C. or 39° C. The tsAMDEs provided herein have a ratio of activity at a low permissive temperature (e.g. less then 37° C., such as at or about 25° C.) compared to a non-permissive temperature of at or about 34° C. or 37° C., for example, 33° C., 34° C., 35° C., 36° C., 37° C., 38° C. or 39° C., that is or is about 1.1, 1.2, 1.3, 1.4, 1.5, 1.6, 1.7, 1.8, 1.9, 2.0, 2.5, 3.0, 3.5, 4.0, 4.5, 5, 5.5, 6, 6.5, 7, 7.5, 8, 8.5, 9, 9.5, 10, 15, 20, 30, 40, 50 or more. Thus, the activity of the tsAMDEs provided herein at the non-permissive temperature of at or about 34° C. or 37° C. is or is about 70%, 65%, 60%, 55%, 50%, 45%, 40%, 35%, 30%, 25%, 20%, 15%, 10%, 5%, 4%, 3%, 2%, 1%, 0.5% or less of the activity at the permissive temperature at or about 25° C.

tsAMDEs, for example tsMMPs, provided herein retain one or more activities of wild-type enzyme, for example, enzymatic activity for cleavage of an ECM component such as collagen. For example, a tsAMDEs provided herein retains an activity at the permissive temperature that is or is about 30%, 40%, 50%, 60%, 70%, 80%, 90%, 100%, 110%, 120%, 140%, 150% or more the activity of wild-type AMDE at the permissive temperature. Generally, tsAMDEs provided herein, however, are less active the then wild-type enzyme at the higher nonpermissive temperature, e.g. physiologic temperature. For example, tsAMDEs provided herein exhibit 95%, 90%, 80%, 70%, 65%, 60%, 55%, 50%, 45%, 40%, 35%, 30%, 25%, 20%, 15%, 10%, 5%, 4%, 3%, 2%, 1%, 0.5%, generally 40%, 30%, 25%, 20%, 15%, 10%, or 5% residual activity of the wild-type enzyme at physiologic temperature (e.g. 34 or 37° C.).

Where the activating condition is temperature, an activator can be provided that exposes the tsAMDEs to the permissive temperature required for activation. The exposure to the activator can be in vitro or in vivo. The activator can be exposed to the tsAMDEs prior to, simultaneously, subsequently or intermittently upon in vivo administration. The activator can provide the requisite heat or cold required for activation. For example, where the activating condition is low temperature, the activator can be provided as a cold buffer or as an ice pack to be applied to the site of administration. Where the activating condition is heat, the activator can be provided as a warm buffer or as a heat pack to be applied to the site of administration. The activating condition also can be provided by storage of the tsAMDE at the permissive temperature immediately and just prior to use. The duration of exposure to the activator can be continuous, can be for a predetermined time, or can be intermittent (for example, if the tsAMDEs is reversible). Thus, the time period permitting activation is flexible and can be adapted to the particular enzyme that is used, the disease or condition being treated, the site of administration or other factors. It is within the level of the skilled artisan to determine the duration of exposure to the activator.

In the absence of exposure to the activator providing the activating condition, the tsAMDE present at the non-permissive temperature are inactive or substantially inactive compared to the activity at the permissive temperature. The activating condition of a permissive temperature (e.g. low temperature) not normally present at the site of administration permits the temporal regulation of, and alteration of, the physiological parameters of organs and tissues, such as the interstitium that exhibits a physiologic temperature of approximately 37° C. Under normal physiological conditions, the temperature of the interstitium is approximately 37° C. Thus, for example, tsAMDEs active at low temperatures, when present in the interstitium would normally be catalytically inactive because of the physiologic temperature of the interstitium. When the temperature of the interstitium is temporarily rendered cold, for example, by exposure to a cold buffer or to a cold pack administered on the adjacent surface, tsAMDEs when administered to the interstitium will become activated. When the temperature increases and returns to physiological levels, then the tsAMDEs become inactivate or substantially inactive and cease to exert their enzymatic activity. Hence, by taking advantage of the requirement for exogenous activating conditions, tsAMDEs are activatable and can be made temporally active for a limited duration during use, such as upon in vivo administration to the body.

The tsAMDEs provided herein include those that are irreversibly inactive following exposure to non-permissive temperatures. Such mutants are active when exposed to permissive temperature conditions (e.g. 25° C.), but are less active or inactive when the temperature is altered to a non-permissive temperatures (e.g. 37° C., such as can occur upon in vivo administration to the body and removal of an exogenous activator (e.g. cold pack)). For example, upon return to permissive conditions, irreversible tsAMDEs polypeptides provided herein exhibit at or about 50%, 60%, 70%, 80%, 90%, 100%, 105%, 110%, 115%, or 120% the activity at non-permissive temperatures. The activity is not reversible.

Also provided herein are tsAMDEs that are reversibly inactive following exposure to a non-permissive temperature. Such mutants are active when exposed to a permissive temperature condition, but are less active or inactive when the temperature is altered to a non-permissive temperatures. Upon renewed exposure to an activating condition providing the permissive temperature (e.g. cold pack), the activity of the tsAMDEs is restored, thereby rendering the enzyme sufficiently active to degrade one or more components of the ECM. For example, upon return to permissive conditions from nonpermissive conditions, reversible tsAMDEs polypeptides provided herein exhibit at or about 120%, 125%, 130%, 140%, 150%, 160%, 170%, 180%, 200% or more the activity at non-permissive temperatures.

Typically, tsAMDEs provided herein are zymogens (containing a propeptide) or processed enzymes (lacking a propeptide), or catalytically active forms thereof. As discussed below, most enzymes, including MMPs, are zymogens and require an initial processing event for activity by removal of a propeptide segment from the N-terminal end of the polypeptide. A processing agent, such as a protease or chemical agent, directly or indirectly initiates one or more cleavage events to generate an active enzyme by virtue of removal of the propeptide segment and/or conformational changes that expose the active site of the enzyme. Hence, normally, upon processing of an enzyme to a mature form, the enzyme is active. The activity of a processed enzyme is not reversible, thereby leading to uncontrolled degradation of the ECM upon administration of the processed enzyme to the body. It is contemplated herein that modification of the enzyme to additionally confer temperature sensitivity provides a mechanism to conditionally and temporally control activation of the enzyme to avoid continued activation of the processed form.

Any AMDE, whether synthetic or isolated from natural sources, such as those set forth in Table 3 or elsewhere herein, zymogen forms thereof, mature forms thereof lacking the propeptide, and catalytically active forms including polypeptides containing only the catalytically active domain, and allelic or species variants or other variants thereof, or any known to those of skill in the art can be modified to be temperature sensitive and is intended for use in the compositions, combinations, methods and apparatus provided herein, so long as the enzyme is activatable due to the requirement of a temperature activating condition. One of skill in the art knows or could identify tsAMDEs. For example, one of skill in the art could use routine molecular biology techniques to introduce amino acid mutations into a matrix-degrading enzyme, and test each for enzyme activation under temperature permissive and non-permissive temperatures to assess the requirement of an exogenous activating condition for sustained or reversible activation of any desired enzyme. Exemplary assays for enzyme activation are provided herein and known in the art, Hence, tsAMDEs provided herein include zymogen forms (e.g. proenzyme), active enzymes lacking a propeptide, and polypeptides containing only the catalytically active domains thereof so long as the tsMMPs exhibits enzymatic activity at the permissive temperature. Hence, modification of the enzyme is in an active form thereof. Exemplary of such a tsAMDEs is a tsMMP-1. tsMMP-1 provided herein contains one or more amino acid modifications in its primary sequence corresponding to amino acid replacements in a wild-type MMP-1 set forth in SEQ ID NO: 327. Exemplary modifications are described below. The tsMMP-1 mutants provided herein include those that are zymogens or those that are active enzymes lacking a propeptide so long as such forms contain the mutation. The zymogen or active polypeptides provided herein include those that are full-length, include all or a portion of the proline rich linker or the hemopexin binding domain, lack all or a portion of the proline rich linker or the hemopexin binding domain, or polypeptides that include only the catalytically active domains thereof (e.g. corresponding to amino acids 81-242 of the sequence of amino acids set forth in SEQ ID NO: 327) so long as the tsMMP-1 retains enzymatic activity at the permissive temperature.

It is understood that when provided in zymogen form, the tsAMDEs are inactive and that processing by a processing agent is required for activity. Generally, the processing of the enzyme is effected prior to use, such as prior to administration in vivo. The processing agent can be applied simultaneously, intermittently or subsequently to exposure of the tsAMDEs to the activating condition (e.g. low temperature) and administration to the body. Generally, the processing agent is chosen that is acceptable for administration to a subject. If desired, the processing agent can be purified away from the enzyme, for example by dialysis or other purification method, before administration. Thus, for zymogen forms of the enzyme, two steps are required for activation: 1) exposure to a processing agent; and 2) exposure to an activating condition. Whether in zymogen or processed form, exposure of the tsAMDEs to an activator at the permissive temperature temporally controls activity of a tsAMDE.

tsAMDEs can be further modified to alter any one or more properties or activities. For example, altered properties or activities include, but are not limited to, modification that render the enzyme more stable, alter the substrate specificity and/or increase resistance to one or more inhibitors. For example, as described elsewhere herein, tsAMDEs can be modified to alter its substrate specificity. For example, an enzyme can be modified to have increased specificity for a particular substrate. Thus, for example, a tsAMDE, which exhibits substrate specificity for type I and type IV collagen can be modified so that it has increased substrate specificity for type I collagen, and not type IV collagen, and vice versa. If desired, enzyme stability also can be increased by pegylation or glycosylation of the enzyme. Modifications of polypeptides can be achieved by routine molecular biology techniques, and are within the skill of one in the art. For purposes herein, modified tsAMDEs retain one or more activities of the wild-type enzyme at the permissive temperature. Retained activity can be 40%, 50%, 60%, 70%, 80%, 90%, 95%, 100%, 110%, 120%, 130%, 140%, 150%, or more activity of the wild-type MMP at the permissive temperature. Modified enzymes can be tested for their substrate specificity using routine assays for substrate cleavage such as is described herein, or known in the art. For example, substrate cleavage can be assessed on fluorogenic peptides or on purified proteins. Cleavage can be assessed using in vitro or in vivo assays. For example, cleavage can be assessed by incubating the enzyme with the substrate, and then running the mixture on an SDS-PAGE gel. Degradation can be assessed by Western Blot or by using standard protein stains such as Coomasie Blue or Silver Stain reagents.

The tsAMDEs are provided herein as compositions, combinations and containers. The tsAMDEs are provided in a therapeutically effective amount, that when activated, degrade one or more components of the ECM upon administration, such as upon sub-epidermal administration. The resulting tsAMDEs can be used as therapeutics to treat ECM-mediated diseases or conditions.

For example, the tsAMDEs are provided in compositions, combinations and/or containers with an activator that provides the activating condition. In some examples, tsAMDEs also are provided in compositions, combinations and/or containers with a processing agent. The activator and/or processing agent can be in the same composition or in separate compositions and in the same container or separate containers with the tsAMDEs. In addition, the tsAMDEs also can be combined or provided in combination, such as in containers, with other agents such as any one or more of an anesthetic, alpha-adrenergic agent, dispersing agent, or therapeutic agent. The tsAMDEs can be provided in the same or separate composition as other agents and/or can be provided in the same or separate containers.

The tsAMDEs can be provided as a liquid or in lyophilized form at a therapeutically effective concentration. Alternatively, the tsAMDEs can be provided as a concentrated liquid, such that addition of a sufficient amount of activator results in a therapeutically effective concentration of enzyme. The enzymes can be provided as a solution or suspension or encapsulated into a suitable delivery vehicle, such as a liposome, glass particle, capillary tube, drug delivery vehicle, gelatin, gel, tablet, capsule, pill, time release coating, as well as transdermal patch preparation and dry powder inhalers or other such vehicle. The activator typically is provided as a liquid solution or suspension for administration into the interstitium either alone or following reconstitution of and/or exposure to the tsAMDEs. In some examples, the activator is provided exogenously and applied at the site of administration. For example, an activator can be a hot or cold pack that can be applied to the site of administration, e.g. the skin, prior to, simultaneously, subsequently or intermittently following administration of a tsAMDEs. As described below, kits containing these combinations and also articles of manufacture, such as containers, also are provided.

Thus, when desired, the tsAMDEs enzyme is subjected to activating conditions in which the enzyme is exposed to an activator to generate an enzyme that is active. Exposure to an activator can be achieved in vitro or in vivo. For example, where an activatable enzyme and activator are separately provided, they can be administered together or separately. Where administered separately, the tsAMDEs can be administered simultaneously, subsequently or intermittently from the activator. In another example, the tsAMDEs, in a lyophilized or concentrated liquid form, can be reconstituted with the activator just prior to use. In such an example, the mixture of the tsAMDEs and activator are administered together. Such methods of activation can be empirically determined by one of skill in the art, and may differ depending on the choice of enzyme and activator, and the method of treatment and treatment regime desired.

The activatable matrix-degrading enzyme can be provided in an article or manufacture alone or in combination with the activator. For example, if the enzyme is provided in combination with the activator, an article of manufacture can contain an enzyme, either lyophilized or in liquid form, in one compartment, and an activator in an adjacent compartment. The compartments can be separated by a dividing member. Articles of manufacture can additionally contain a processing agent. Such articles of manufacture are described elsewhere herein.

The combinations of tsAMDEs and activator also can further contain other agents, discussed in detail below. For example, in addition to the activator and tsMMP, combinations are provided containing one or more of a anesthetic, vasoconstrictor, dispersing agent or other therapeutic agent.

i. Temperature-Sensitive Matrix Metalloprotease Mutants

Provided herein are tsMMP polypeptides, for example tsMMP-1 polypeptides, that are temperature sensitive by virtue of modifications in the primary sequence of the polypeptide compared to an unmodified MMP polypeptide. The tsMMP polypeptide exhibits increased enzymatic activity at a permissive temperature compared with activity of the tsMMP polypeptide at a non-permissive temperature. For example, tsMMP polypeptides provided herein exhibit increased enzymatic activity at a low temperature that is less then 37° C., for example, that is at or about 20° C., 21° C., 22° C., 23° C., 24° C., 25° C., 26° C., 27° C., 28° C., 29° C. or 30° C., in particular at or about 25° C. compared to a non-permissive high temperature that is at or about 34° C., 35° C., 36° C., 37° C., 38° C. or 39° C., in particular at or about 34° C. or 37° C. Due to the temperature-dependent activity of tsMMP polypeptides, the activity of MMP can be conditionally controlled, thereby temporally regulating activation to prevent prolonged and unwanted degradation of the ECM. In particular, such tsMMP polypeptides can be used in uses, processes or methods to treat diseases or conditions of the ECM, for example, to treat collagen-mediated diseases or conditions such as cellulite.

The tsMMP polypeptides provided herein have a ratio of activity at a permissive temperature compared to a non-permissive temperature that is or is about 1.1, 1.2, 1.3, 1.4, 1.5, 1.6, 1.7, 1.8, 1.9, 2.0, 2.5, 3.0, 3.5, 4.0, 4.5, 5, 5.5, 6, 6.5, 7, 7.5, 8, 8.5, 9, 9.5, 10, 15, 20, 30, 40, 50 or more. Thus, the activity of tsMMP polypeptides provided herein at the non-permissive temperature is or is about 70%, 65%, 60%, 55%, 50%, 45%, 40%, 35%, 30%, 25%, 20%, 15%, 10%, 5%, 4%, 3%, 2%, 1%, 0.5% or less of the activity at a permissive temperature. tsMMPs polypeptides provided herein retain one or more activities of wild-type MMP polypeptide, for example, enzymatic activity for cleavage of an ECM component such as collagen. Typically, such activity is substantially unchanged (less than 1%, 5%, 10%, 20% or 30% changed) compared to a wild-type or starting protein. In other examples, the activity of a modified MMP polypeptide is increased or is decreased as compared to a wild-type or starting MMP-1 polypeptide. Activity is assessed at the permissive temperature and is compared to the activity of a starting, unmodified MMP polypeptide at the permissive temperature or a non-permissive temperature. For example, a tsMMP polypeptide provided herein retains an activity at the permissive temperature that is or is about 10%, 20%, 30%, 40%, 50%, 60%, 70%, 80%, 90%, 100%, 110%, 120%, 140%, 150% or more the activity of wild-type MMP-1 at the permissive temperature or non-permissive temperature. Activity can be assessed in vitro, ex vivo or in vivo and can be compared to that of the unmodified MMP polypeptide, such as for example, an inactive MMP polypeptide set forth in SEQ ID NO: 327 activated by a processing agent, or any other MMP polypeptide known to one of skill in the art that is used as the starting material. As discussed elsewhere herein, it is understood that the zymogen inactive form of an MMP or a modified MMP must be processed to an active form before use or measurement of an activity.

Modifications in an MMP polypeptide can be made to any form of an MMP polypeptide, including inactive or active forms, allelic and species variants, splice variants, variants known in the art, or hybrid or chimeric MMP polypeptides. For example, modifications provided herein can be made in any exemplary MMP polypeptide set forth in Table 3, including precursor polypeptides, inactive proenzyme forms, zymogen forms, active forms thereof and allelic or species variants thereof. For example, an exemplary MMP is an precursor MMP-1 polypeptide set forth in SEQ ID NO:98, an inactive pro-enzyme MMP-1 containing the propeptide set forth in SEQ ID NO: 327, a mature MMP-1 polypeptide lacking the propeptide set forth in SEQ ID NO: 99, or any species, allelic or modified variant and active fragments thereof that has 40%, 50%, 60%, 70%, 80%, 90%, 91%, 92%, 93%, 94%, 95%, 96%, 97%, 98%, or 99% sequence identity to any of the MMP-1 polypeptides set forth in SEQ ID NOS: 98-99, 327. Modifications also can be in an MMP polypeptide lacking one or more domains, so long as the MMP polypeptide is temperature sensitive (i.e. contains the modification) and retains enzymatic activity. For example, modifications can be in an MMP polypeptide that includes only the catalytic domain (for example in MMP-1 corresponding to amino acids 81-242 of the proenzyme MMP-1 polypeptide set forth in SEQ ID NO: 327). Modifications also can be made in an MMP polypeptide lacking all or a portion of the proline rich linker (for example in MMP-1 corresponding to amino acids 243-258 of the proenzyme MMP-1 polypeptide set forth in SEQ ID NO: 327) and/or lacking all or a portion of the hemopexin binding domain (for example in MMP-1 corresponding to amino acids 259-450 of the proenzyme MMP-1 polypeptide set forth in SEQ ID NO: 327). Allelic variants of MMP-1 polypeptides include, but are not limited to, any of MMP-1 polypeptide containing any one or more amino acid variant set forth in SEQ ID NO:537. Exemplary species variants for modification herein include, but are not limited to, pig, rabbit, bovine, horse, rat, and mouse, for example, set forth in any of SEQ ID NOS: 527-532. Modifications in an MMP polypeptide provided herein to confer temperature sensitivity can be made to an MMP polypeptide that also contains other modifications, such as those described in the art, including modification of the primary sequence and modifications not in the primary sequence of the polypeptide. It is understood that modifications in an allelic or species variant or other variant include modification in any form thereof such as an active or inactive form, a form including only the catalytic domain, or a form lacking all or a portion of the proline rich linker or the hemopexin binding domain so long as the modified form contains the temperature sensitive modification and is temperature sensitive. As discussed herein below, corresponding MMP-1 modifications can be made to similar forms of other MMP polypeptides.

Hence, the resulting modified MMP polypeptides include those that are inactive zymogen proenzymes and those that are active polypeptides. For example, any modified polypeptide provided herein that is a zymogen proenzyme can be activated by a processing agent to generate an active MMP polypeptide. Processing agents include, but are not limited to, any set forth in Table 3A below. Activation of MMP-1 polypeptides are typically exhibited in its active form following cleavage of the propeptide and/or intermolecular and intramolecular processing of the enzyme to remove the propeptide (see e.g. Visse et al. (2003) Cir. Res., 92:827-839; Khan et al. (1998) *Protein Science,* 7:815-836; Okada et al. (1988) *Biochem J.,* 254:731-741; Okada & Nakanashi (1989) *FEBS Lett.,* 249:353-356; Nagase et al. (1990) *Biochemistry,* 29:5783-5789; Koklitis et al. (1991) *Biochem J.,* 276:217-221; Springman et al. (1990) *PNAS,* 87:364-8; Murphy et al. (1997) *Matrix Biol.,* 15:511-8).

TABLE 3A

Zymogen Activators

| Proteolytic Compounds | |
|---|---|
| Proteases | Plasmin |
| | Plasma kallikrein |
| | Trypsin-1 (Trypsin I) |
| | Trypsin-2 (Trypsin II) |
| | Neutrophil elastase |
| | Cathepsin G |
| | Tryptase |
| | Chymase |
| | Proteinase-3 |
| | Furin |
| | uPA |
| | MMPs, including MMP-1, MMP-2, MMP-3, MMP-7, MMP-10, MMP-26, and MT1-MMP |
| Non-Proteolytic Compounds | |
| Thiol-modifying Agents | 4-aminophenylmercuric acetate (AMPA) |
| | HgCl$_2$ |
| | N-ethylmaleimide |
| Conformational Perturbants | Sodium dodecyl sulfate (SDS) |
| | Chaotropic agents |
| Other Chemical Agents | Oxidized glutathione (GSSG) |
| | Reactive oxygen |
| | Au(I) salts |
| Other Activating Conditions | |
| | Acidic pH |
| | Heat |

Modifications provided herein of a starting, unmodified reference polypeptide include amino acid replacements or substitutions, additions or deletions of amino acids, or any combination thereof. For example, tsMMP polypeptides include those with 1, 2, 3, 4, 5, 6, 7, 8, 9, 10, 11, 12, 13, 14, 15, 16, 17, 18, 19, 20 or more modified positions. Also provided herein are modified tsMMP polypeptides with two or more modifications compared to a starting reference MMP-1 polypeptide. Modified MMP polypeptides include those with 2, 3, 4, 5, 6, 7, 8, 9, 10, 11, 12, 13, 14, 15, 16, 17, 18, 19, 20 or more modified positions. Any modification provided herein can be combined with any other modification known to one of skill in the art so long as the resulting modified MMP polypeptide retains enzymatic activity when it is in its activated form and so long as the enzymatic activity is greater at the permissive temperature compared to the non-permissive temperature. Modified MMP polypeptides provided herein can be assayed for enzymatic activity under various conditions (e.g. permissive and non-permissive temperatures) to identify those that retain enzymatic activity.

The modifications provided herein can be made by standard recombinant DNA techniques such as are routine to one of skill in the art. Any method known in the art to effect mutation of any one or more amino acids in a target protein can be employed. Methods include standard site-directed mutagenesis (using e.g. a kit, such as QuikChange available from Stratagene) of encoding nucleic acid molecules, or by solid phase polypeptide synthesis methods.

Other modifications that are or are not in the primary sequence of the polypeptide also can be included in a modified MMP polypeptide, or conjugate thereof, including, but not limited to, the addition of a carbohydrate moiety, the addition of a polyethylene glycol (PEG) moiety, the addition of an Fc domain, etc. For example, such additional modifications can be made to increase the stability of half-life of the protein.

1) Exemplary tsMMP-1 Modifications

Provided herein are modified MMP-1 polypeptides containing one or more amino acid modifications in a starting, unmodified MMP-1 polypeptide. The amino acid replacement or replacements can be at any one or more positions corresponding to any of the following positions: 84, 85, 95, 98, 99, 100, 103, 104, 105, 106, 109, 110, 111, 112, 118, 123, 124, 126, 147, 150, 151, 152, 153, 155, 156, 158, 159, 170, 171, 176, 178, 179, 180, 181, 182, 183, 185, 187, 188, 189, 190, 191, 192, 194, 195, 197, 198, 206, 207, 208, 210, 211, 212, 218, 223, 227, 228, 229, 230, 233, 234, 237, 240, 251, 254, 255, 256, 257 and 258 of an unmodified MMP-1 polypeptide having a sequence of amino acids set forth in SEQ ID NO: 327, or at a corresponding position in an allelic or species variant or other variant of an MMP-1 polypeptide that has at least or at least about 60%, 70%, 75%, 80%, 85%, 90%, 91%, 92%, 93%, 94%, 95%, 96%, 97%, 98%, 99% or more sequence identity to an MMP-1 polypeptide set forth in SEQ ID NO: 327. Amino acid replacements include replacement of amino acids to an acidic (D or E); basic (H, K or R); neutral (C, N, Q, T, Y, S, G) or hydrophobic (F, M, W, I V, L A, P) amino acid residue. For example, amino acid replacements at the noted positions include replacement by amino acid residues E, H, R, C, Q, T, S, G, M, W, I, V, L, A, P, N, F, D, Y or K. Such modified MMP-1 polypeptides include MMP-1 polypeptides that are temperature sensitive by virtue of increased activity at the permissive temperature of 25° C. compared to the non-permissive temperatures of 34° C. or 37° C.

For example, modified MMP-1 polypeptides provided herein can include polypeptides having an amino acid modification corresponding to any one or more modifications of T84F (i.e. replacement of T by F at a position corresponding to position 84 of an MMP-1 polypeptide set forth in SEQ ID NO:327), E85F, L95K, L95I, R98D, I99Q, E100V, E100R, E100S, E100T, E100F, E100I, E100N, T103Y, P104A, P104M, D105A, D105F, D105G, D105I, D105L, D105N, D105R, D105S, D105T, D105W, D105E, L106C, L106S, A109H, D110A, V111R, D112S, A118T, S123V, N124D, T126S, G147P, R150P, R150V, R150D, R150I, R150H, D151G, N152A, N152S, S153T, F155L, F155A, D156H, D156L, D156A, D156W, D156V, D156K, D156T, D156R, D156M, P158T, P158G, P158K, P158N, G159V, G159T, G159M, G159I, G159W, G159L, G159C, P170D, P170A, G171P, G171E, G171D, A176F, A176W, F178T, F178L, D179N, D179V, D179C, E180Y, E180R, E180T, E180F, E180G, E180S, E180N, E180D, E181T, D181L, D181K, D181C, D181G, E182T, E182Q, E182M, E182G, E183G, R183S, T185R, T185Y, T185H, T185G, T185V, T185Q, T185A, T185E, T185D, N187R, N187M, N187W, N187F, N187K, N187I, N187A, N187G, N187C, N187H, F188V, R189N, R189T, R189Q, E190G, E190Y, E190D, Y191V, N192H, N192S, N192D, N192C, H194P, R195c, R195W, R195L, R195G, R195Q, R195A, R195D, R195V, A197C, A197V, A198G, A198L, A198M, G206A, G206S, L207R, L207V, L207I, L207G, S208R, S208L, S210V, S210A, T211L, D212G, D212H, Y218S, F223C, F223E, F223G, F223A, F223S, F223K, F223M, V227C, V227D, V227E, V227L, V227S, V227W, V227G, V227H, V227Q, V227R, Q228P, L229A, L229T, L291, A230V, D233E, I234A, I234T, I234E, I234Q, I237L, I237W, I237N, I240S, I240A, I240C, I251S, I251W, Q254S, T255H, P256C, K257P, K257T and A258P. Exemplary modified MMP-1 polypeptides have a sequence of amino acids set forth in any of SEQ ID NOS: 328-526 and active forms and other forms thereof, and allelic and species variants thereof.

In some examples, such modified MMP-1 polypeptides include polypeptides having an amino acid replacement or replacements at any one or more positions corresponding to any of the following positions: 95, 100, 103, 105, 150, 151, 153, 155, 156, 159, 171, 176, 179, 180, 181, 182, 185, 187, 190, 191, 192, 194, 195, 198, 206, 207, 210, 212, 218, 223, 227, 228, 229, 230, 233, 234, 237 and 240 of an unmodified MMP-1 polypeptide having a sequence of amino acids set forth in SEQ ID NO: 327, or at a corresponding position in an allelic or species variant or other variant of an MMP-1 polypeptide that has at least or at least about 60%, 70%, 75%, 80%, 85%, 90%, 91%, 92%, 93%, 94%, 95%, 96%, 97%, 98%, 99% or more sequence identity to an MMP-1 polypeptide set forth in SEQ ID NO: 327. For example, modified MMP-1 polypeptides provided herein include polypeptides having an amino acid modification corresponding to any one or more modifications of L95K, E100V, T103Y, D105A, D105F, D105G, D105I, D105L, D105N, D105R, D105S, D105T, D105W, R150P, D151G, S153T, F155L, F155A, D156H, D156L, D156A, D156W, D156V, D156K, D156T, D156R, G159V, G159T, G171P, A176F, D179N, E180Y, E180R, E180T, E180F, E181T, D181L, D181K, E182T, E182Q, T185R, T185Y, T185H, T185G, T185V, T185Q, T185A, T185E, N187R, N187M, N187W, N187F, N187K, N1871, N187A, E190G, Y191V, N192H, N192S, N192D, N192C, H194P, R195c, R195W, R195L, R195G, R195Q, R195A, R195D, R195V, A198G, A198L, A198M, G206A, G206S, L207R, L207V, S210V, D212G, Y218S, F223C, F223E, F223G, F223A, F223S, V227C, V227D, V227E, V227L, V227S, V227W, Q228P, L229A, L229T, L229I, A230V, D233E, I234A, I234T, I234E, I234Q, I237L, I240S, I240A, and I240C. Such modified MMP-1 polypeptides exhibit at least 1.2 times or more activity at the permissive temperature of 25° C. compared to the non-permissive temperatures of 34° C. or 37° C., for example, 1.2, 1.3, 1.4, 1.5, 1.6, 1.7, 1.8, 1.9, 2.0, 2.5, 3.0, 3.5, 4.0, 4.5, 5, 5.5, 6, 6.5, 7, 7.5, 8, 8.5, 9, 9.5, 10, 15, 20, 30, 40, 50 or more times the activity. Exemplary of such modified MMP-1 polypeptides have a sequence of amino acids set forth in any of SEQ ID NOS: 328, 331-340, 345-352, 354-357, 359, 363, 365, 368, 371, 373-374, 377-378, 380, 382-384, 388-395, 397-398, 401-419, 421-422, 424-426, 428-430, 433, 435, 437-450, 457-459, 462, 465-472, 477-478, 518, and active forms and other forms thereof, and allelic and species variants thereof.

In other examples, such modified MMP-1 polypeptides include polypeptides having an amino acid replacement or replacements at any one or more positions corresponding to any of the following positions: 95, 105, 150, 151, 155, 156, 159, 176, 179, 180, 181, 182, 185, 187, 195, 198, 206, 210, 212, 218, 223, 227, 228, 229, 230, 233, 234, and 240 of an unmodified MMP-1 polypeptide having a sequence of amino acids set forth in SEQ ID NO: 327, or at a corresponding position in an allelic or species variant or other variant of an MMP-1 polypeptide that has at least or at least about 60%, 70%, 75%, 80%, 85%, 90%, 91%, 92%, 93%, 94%, 95%, 96%, 97%, 98%, 99% or more sequence identity to an MMP-1 polypeptide set forth in SEQ ID NO: 327. For example, modified MMP-1 polypeptides provided herein include polypeptides having an amino acid modification corresponding to any one or more modifications of L95K, D105A, D105F, D105G, D105I, D105L, D105N, D105R, D105S, D105T, D105W, R150P, D151G, F155A, D156K, D156T, D156L, D156A, D156W, D156V, D156H, D156R, G159V, G159T, A176F, D179N, E180Y, E180T, E180F, D181L, D181K, E182T, E182Q, T185R, T185H, T185Q, T185A, T185E, N187R, N187M, N187F, N187K, N187I, R195V, A198L, A198M, G206A, G206S, S210V, Y218S, F223E, V227C, V227E, V227W, Q228P, L229T, L2291, D233E, I234A, I234T, I234E, I240S, and I240C. Such modified MMP-1 polypeptides exhibit at least 1.5 times or more activity at the permissive temperature of 25° C. compared to the non-permissive temperatures of 34° C. or 37° C., for example, 1.5, 1.6, 1.7, 1.8, 1.9, 2.0, 2.5, 3.0, 3.5, 4.0, 4.5, 5, 5.5, 6, 6.5, 7, 7.5, 8, 8.5, 9, 9.5, 10, 15, 20, 30, 40, 50 or more times the activity. Exemplary of such modified MMP-1 polypeptides have a sequence of amino acids set forth in any of SEQ ID NOS: 328, 331-340, 345-346, 348-352, 534-357, 359, 363, 365, 368, 373-374, 377-378, 382-384, 388-391, 395, 397-398, 401-402, 404, 411, 415-419, 421-422, 430, 433, 437, 439-441, 443-444, 446-449, and active forms and other forms thereof, and allelic and species variants thereof.

In additional examples, modified MMP-1 polypeptides provide herein include modified MMP-1 polypeptides that are temperature sensitive at the permissive temperature of 25° C. and exhibit at least 30%, for example, 30%, 40%, 50%, 60%, 70%, 80%, 90%, 100%, 110%, 120%, 140%, 150% or more activity at 25° C. compared to wild-type MMP-1 at 25° C. Such modified MMP-1 polypeptides include polypeptides having an amino acid replacement or replacements at any one or more positions corresponding to any of the following positions: 95, 105, 150, 156, 159, 179, 180, 182, 185, 187, 195, 198, 212, 223, 227, 234, and 240 of an unmodified MMP-1 polypeptide having a sequence of amino acids set forth in SEQ ID NO: 327, or at a corresponding position in an allelic or species variant or other variant of an MMP-1 polypeptide that has at least or at least about 60%, 70%, 75%, 80%, 85%, 90%, 91%, 92%, 93%, 94%, 95%, 96%, 97%, 98%, 99% or more sequence identity to an MMP-1 polypeptide set forth in SEQ ID NO: 327. For example, modified MMP-1 polypeptides provided herein include polypeptides having an amino acid modification corresponding to any one or more modifications L95K, D105A, D105G, D105I, D105L, D105N, D105S, D105W, D105T, R150P, D156K, D156T, D156V, D156H, D156R, G159V, G159T, D179N, E180Y, E180T, E180F, E182T, T185H, T185Q, T185E, N187M, N187K, N1871, R195V, A198L, F223E, V227E, I234E and I240S. Exemplary of such modified MMP-1 polypeptides have a sequence of amino acids set forth in any of SEQ ID NOS: 328, 332-335, 337-340, 345, 349-352, 355, 359, 363, 368, 373-374, 377, 384, 388-389, 391, 397, 402, 404, 411, 416, 422, 430, 444, 449, or active forms and other forms thereof, and allelic and species variants thereof.

In particular, modified MMP-1 polypeptides provided herein have an amino acid replacement or replacements at any one or more positions corresponding to any of the following positions: 95, 105, 150, 156, 159, 179, 180, 182, 185, 187, 198, 227, 234 and 240 of an unmodified MMP-1 polypeptide having a sequence of amino acids set forth in SEQ ID NO: 327, or at a corresponding position in an allelic or species variant or other variant of an MMP-1 polypeptide that has at least or at least about 60%, 70%, 75%, 80%, 85%, 90%, 91%, 92%, 93%, 94%, 95%, 96%, 97%, 98%, 99% or more sequence identity to an MMP-1 polypeptide set forth in SEQ ID NO: 327. Such modified MMP-1 polypeptides provided herein include polypeptides having an amino acid modification corresponding to any one or more modifications L95K, D105I, D105N, D105L, D105A, D105G, R150P, D156R, D156H, D156K, D156T, G159V, G159T, D179N, E180T, E180F, E182T, T185Q, N187I, A198L, V227E, I234E and I240S. More particularly, modified MMP-1 polypeptides provided herein include polypeptides having an amino acid modification corresponding to any one or more modifications L95K, D105N, R150P, D156K, D156T, G159V, D179N, E180T, A198L, V227E, and I240S.

Modified MMP-1 polypeptides provided herein include those that exhibit reversible or irreversible (also called non-reversible) temperature-dependent activity. In all cases, modified MMP-1 polypeptides provided herein exhibit increased activity at a permissive temperature (e.g. 25° C.) compared to a non-permissive temperatures (e.g. 34° C. or 37° C.) For non-reversible polypeptides, exposure to the non-permissive temperature prior to, subsequently or intermittently from exposure to the permissive temperature renders the polypeptide irreversibly inactive. Thus, a modified MMP-1 polypeptide that is returned to temperature permissive conditions, for example 25° C., exhibits the same or similar activity of the MMP-1 polypeptide at non-permissive temperatures, for example, 34° C. or 37° C. For example, upon return to permissive conditions, irreversible modified MMP-1 polypeptides provided herein exhibit at or about 50%, 60%, 70%, 80%, 90%, 100%, 105%, 110%, 115%, or 120% the activity at non-permissive temperatures. Exemplary non-reversible modified MMP-1 polypeptides provided herein include polypeptides having an amino acid modification corresponding to any one or more modifications L95K, D105I, D105L, D105N, D105R, D105W, D151G, F155A, D156K, D156T, D156L, D156A, D156W, D156V, D156H, D156R, G159V, A176F, D179N, D181L, D181K, E182T, E182Q, T185R, N187F, N187I, G206A, G206S, V227C, V227E, Q228E, L229T, D233E, I234A, I234T, I234E, I240S, for example, any set forth in any of SEQ ID NOS: 328, 331-332, 337-339, 346, 348, 349-352, 354-357, 363, 365, 368, 378, 382-384, 390, 401, 404, 417-418, 430, 433, 439-440, 443-444, 446-447, 449 or active forms and other forms thereof, and allelic and species variants thereof.

For reversible polypeptides, exposure to the non-permissive temperature prior to, subsequently or intermittently from exposure to the permissive temperature renders the polypeptide reversibly active. Thus, a modified MMP-1 polypeptide that is returned to temperature permissive conditions recovers activity, and thereby exhibits increased activity at the permissive temperature compared to the non-permissive temperature. In such examples, the recovered activity can be complete or is partial. Thus, a modified MMP-1 polypeptide that is returned to temperature permissive conditions, for example 25° C., exhibits an increased activity compared to activity at non-permissive temperatures, for example, 34° C. or 37° C. For example, upon return to permissive conditions, reversible modified MMP-1 polypeptides provided herein exhibit at or about 120%, 125%, 130%, 140%, 150%, 160%, 170%, 180%, 200% or more the activity at non-permissive temperatures. Exemplary non-reversible modified MMP-1 polypeptides provided herein include polypeptides having an amino acid modification corresponding to any one or more modifications D105A, D105F, D105G, D105S, D105T, R150P, G159T, E180Y, E180T, E180F, T185H, T185Q, T185A, T185E, N187R, N187M, N187K, R195V, A198L, A198M, S210V, Y218S, F223E, V227W, L229I and I240C, for example, any set forth in any of SEQ ID NOS: 333-336, 340, 345, 359, 373-374, 377, 388-389, 391, 395, 397-398, 402, 411, 415-416, 419, 421-422, 437, 441, 448, or active forms and other forms thereof, and allelic and species variants thereof.

2) Combinations

Provided herein are modified MMP-1 polypeptides that contain 2, 3, 4, 5, 6, 7, 8, 9, 10, 11, 12, 13, 14, 15, 16, 17, 18, 19, 20 or more modifications compared to a starting or reference MMP-1 polypeptide. Modified MMP-1 polypeptides provided herein can contain any two or more modifications provided above. For example, modified MMP-1 polypeptides provided herein contain amino acid replacements at any two or more positions corresponding to any of the following positions: 84, 85, 95, 98, 99, 100, 103, 104, 105, 106, 109, 110, 111, 112, 118, 123, 124, 126, 147, 150, 151, 152, 153, 155, 156, 158, 159, 170, 171, 176, 178, 179, 180, 181, 182, 183, 185, 187, 188, 189, 190, 191, 192, 194, 195, 197, 198, 206, 207, 208, 210, 211, 212, 218, 223, 227, 228, 229, 230, 233, 234, 237, 240, 251, 254, 255, 256, 257 and 258 of an unmodified MMP-1 polypeptide having a sequence of amino acids set forth in SEQ ID NO: 327, or at a corresponding position in an allelic or species variant or other variant of an MMP-1 polypeptide that has at least or at least about 60%, 70%, 75%, 80%, 85%, 90%, 91%, 92%, 93%, 94%, 95%, 96%, 97%, 98%, 99% or more sequence identity to an MMP-1 polypeptide set forth in SEQ ID NO: 327. Generally, such combination mutants are temperature sensitive and exhibit increased enzymatic activity at a permissive temperature compared with activity of the tsMMP-1 polypeptide at a non-permissive temperature. Typically, combination mutants also retain activity at the permissive temperature compared to the single mutant MMP-1 polypeptides alone or compared to an unmodified MMP-1 polypeptide not containing the amino acid changes (e.g a wild-type MMP-1 polypeptide set forth in SEQ ID NO: 327 or active forms or other forms thereof) at the permissive or non-permissive temperature.

Exemplary MMP-1 combination mutants provided herein contain amino acid replacements at any two or more positions corresponding any of the following positions: 95, 105, 150, 156, 159, 179, 180, 182, 185, 187, 198, 227, 234 and 240 of an unmodified MMP-1 polypeptide having a sequence of amino acids set forth in SEQ ID NO: 327, or at a corresponding position in an allelic or species variant or other variant of an MMP-1 polypeptide that has at least or at least about 60%, 70%, 75%, 80%, 85%, 90%, 91%, 92%, 93%, 94%, 95%, 96%, 97%, 98%, 99% or more sequence identity to an MMP-1 polypeptide set forth in SEQ ID NO: 327. For example, modified MMP-1 polypeptides provided herein include polypeptides having amino acid modification corresponding to any two or more modifications L95K, D105I, D105N, D105L, D105A, D105G, R150P, D156R, D156H, D156K, D156T, G159V, G159T, D179N, E180T, E180F, E182T, T185Q, N187I, A198L, V227E, I234E and I240S. More particularly, modified MMP-1 polypeptides provided herein include polypeptides having amino acid modification corresponding to any two or more modifications L95K, D105N, R150P, D156K, D156T, G159V, D179N, E180T, A198L, V227E, and I240S. It is understood that at least two different positions are modified in the combination mutants provided herein. Exemplary MMP-1 combination mutant polypeptides provided herein are set forth in Table 27 in Example 29.

3) Additional Modifications

Any modified MMP, for example any modified MMP-1, polypeptide provided herein also can contain one or more other modifications described in the art. The additional modifications can include, for example, any amino acid substitution, deletion or insertion known in the art. In addition to containing one or modification described above, any modified MMP-1 polypeptide provided herein can contain 1, 2, 3, 4, 5, 6, 7, 8, 9, 10, 11, 12, 13, 14, 15, 16, 17, 18, 19, 20 or more additional modifications, so long as the resulting MMP-1 polypeptides exhibits increased activity at the permissive temperature (e.g. 25° C.) compared to the non-permissive temperature (e.g. 34° C. or 37° C.) and retains activity of wild-type MMP-1 at the permissive or non-permissive temperature. The additional modifications can confer additional properties to the enzyme, for example, increased stability, increased half-life and/or increased resistance to inhibitors, for example, TIMP. The additional modifications include modifications to the primary sequence of the polypeptide, as well as other modification such as PEGylation and glycosylation of the polypeptide. Generally, such polypeptides include one or more modifications provided herein and exhibit increased activity at the lower temperature then a higher temperature. Exemplary modifications that can be included in a polypeptide provided herein include, but are not limited to, modifications T4P, Q10P, R30M, R30S, T96R, A114V, F166C, I172V, D181H, R189T, E200A, G214E, D232N, D233G, R243S, Q254P, T286A, I298T, E314G, F315S, V374M, R386Q, S387T, G391S, and T432A of a polypeptide set forth in SEQ ID NO: 327.

4) Other MMPs

Matrix metalloproteases are highly homologous polypeptides and exhibit similar specificities for extracellular matrix components. Exemplary sequences of MMPs are set forth in Table 3, for example, any set forth in SEQ ID NOS: 1, 711, 714, 717, 720, 723, 726, 729, 732, 735, 738, 741, 744, 747, 750, 753, 756, 759, 762, 765, 768, 771, 774 or 777 or zymogen forms, active forms or other forms thereof, or allelic or species variants thereof. FIGS. 1A-G provide an alignment of the zymogen form of exemplary MMP polypeptides. Thus, any of the modifications provided herein in an MMP-1 can be made in any other MMP polypeptide. Hence, based on the description herein, any MMP, species, allelic variant or other variant, can be made temporally active (reversible or irreversible) by virtue of activity at a pennissive temperature (generally a lower temperature) compared to a nonpermissive temperature (generally a higher temperature). Such tsMMP mutants can be used by one of skill in the art and used in compositions, processes or methods for the treatment of ECM-mediated diseases or conditions.

It is within the level of one of skill in the art to align various MMPs to MMP-1 (for example set forth in SEQ ID NO: 327) and identify corresponding residues. Any of the modifications provided herein can be made in any other MMP at the corresponding residue. One of skill in the art can test the activity of the resulting modified polypeptide for temperature sensitivity at a permissive temperature compared to a non-permissive temperature. In particular, it is understood that conservative amino acid differences at a corresponding position in an MMP are functionally invariant. Thus, where a residue in MMP-1 aligns with a conservative residue thereto in another MMP, it is understood that such a residue is contemplated for modification herein. For example, position 95 in an MMP-1 set forth in SEQ ID NO: 327 is a leucine (L). Alignment of SEQ ID NO: 327 with other MMPs shows that position 95 in other MMPs is a leucine, isoleucine (I) or valine (V) residue (see FIGS. 1A-G). Each of L, I and V are conservative residues.

In particular, provided herein are modified MMP polypeptides that are modified by one or more amino acid replacement to confer temperature sensitivity by effecting a corresponding MMP-1 modification at a corresponding residue in an MMP. FIGS. 2A-D depict exemplary amino acid residues for modification. It is understood that these identified residues are exemplary only and it is within the level of one of skill in the art to effect modification of an MMP at other amino acid residues or other MMP-1 corresponding residues to confer temperature sensitivity. Exemplary modifications provided herein include modification of any MMP, for example, an MMP-8, MMP-13, MMP-18, MMP-2, MMP-9, MMP-3, MMP-10, MMP-11, MMP-7, MMP-26 and MMP-12, at any one or more positions corresponding to any of the following positions: 95, 105, 151, 156, 159, 176, 179, 180, 181, 182, 185, 195, 198, 206, 210, 212, 218, 223, 228, 229, 233, 234, and 240 of an unmodified MMP-1 polypeptide having a sequence of amino acids set forth in SEQ ID NO: 327. The modification includes any one or more of the modifications provided herein above at the corresponding position to the recited position in MMP-1. For example, residue 95 in an MMP-1 polypeptide set forth in SEQ ID NO: 327 corresponds to residue 113 in an MMP-8 polypeptide set forth in SEQ ID NO: 101. Thus, provided herein are modified MMP-8 polypeptides having an amino acid modification L113K of an unmodified MMP-8 polypeptide having a sequence of amino acids set forth in SEQ ID NO:101. Similar modifications are provided herein based on this description.

Any modified MMP polypeptide provided herein also can contain one or more other modifications described in the art. The additional modifications can include, for example, any amino acid substitution, deletion or insertion known in the art. In addition to containing one or modification described above, any modified MMP polypeptide provided herein can contain 1, 2, 3, 4, 5, 6, 7, 8, 9, 10, 11, 12, 13, 14, 15, 16, 17, 18, 19, 20 or more additional modifications, so long as the resulting MMP polypeptides exhibits increased activity at the permissive temperature (e.g. 25° C.) compared to the non-permissive temperature (e.g. 34° C. or 37° C.) and retains activity of wild-type MMP at the permissive or non-permissive temperature. The additional modifications can confer additional properties to the enzyme, for example, increased stability, increased half-life and/or increased resistance to inhibitors, for example, TIMP. The additional modifications include modifications to the primary sequence of the polypeptide, as well as other modification such as PEGylation and glycosylation of the polypeptide. Generally, such polypeptides include one or more modifications provided herein and exhibit increased activity at the lower thempature then a higher temperature. Exemplary modifications that can be included in a polypeptide provided herein include, but are not limited to, any modifications set forth in Table 3B, below.

TABLE 3B

Exemplary modifications in MMPs

| MMP | SEQ ID NO | Amino Acid Modifications |
|---|---|---|
| MMP-8 | 101 | S3C; T32I; K87E; E154G; D193V; S229T; N246Y; A436V; K460T |

TABLE 3B-continued

Exemplary modifications in MMPs

| MMP | SEQ ID NO | Amino Acid Modifications |
|---|---|---|
| MMP-13 | 104 | H2L; A8V; F75S; D89H; D390G; I427T |
| MMP-2 | 110 | A27S; R101H; D210Y; A228T; F239L; E404K; A447V; T498M; V620I; V621L; S644I |
| MMP-9 | 113 | A20V; N38S; E82K; N127K; L187F; R239H; T258I; Q279R; F571V; P574R; R668Q |
| MMP-3 | 116 | K45E; H113P; R248W |
| MMP-10 | 119 | L4V; V8G; R53K; G65R; E142Q; F226L; G282E; L440F; H475L |
| MMP-11 | 122 | V38A; E44K; P61L; S86P; D166N; F182S; Q323H |
| MMP-7 | 125 | C7W; R77R; S115T; G137D; P241L |
| MMP-26 | 128 | K43E; S46L; I260M |
| MMP-12 | 131 | N357S; F468L; G469R |
| MMP-19 | 146 | R103C; P245S; P488T; T491M |

2. Combinations of Matrix-Degrading Enzymes and Activator

Combinations of an activatable matrix-degrading enzyme and activator, sufficient for activation of the matrix-degrading enzyme, are provided herein. For purposes herein, the activatable matrix degrading enzyme is provided in an inactive form. Generally, compositions of the activatable matrix-degrading enzyme can be provided separate from the activator. The compositions can be provided separately in the same container or in separate containers. Generally, when packaged by itself, the enzyme is provided so that there are insufficient activating conditions present to render the enzyme active.

The matrix-degrading enzyme can be provided as a liquid or in lyophilized form at a therapeutically effective concentration. Alternatively, the matrix-degrading enzyme can be provided as a concentrated liquid, such that addition of a sufficient amount of activator results in a therapeutically effective concentration of enzyme. The enzymes can be provided as a solution or suspension or encapsulated into a suitable delivery vehicle, such as a liposome, glass particle, capillary tube, drug delivery vehicle, gelatin, tablet, capsule, pill, time release coating, as well as transdermal patch preparation and dry powder inhalers or other such vehicle. The activator typically is provided as a liquid solution or suspension for administration into the interstitium either alone or following reconstitution of and/or exposure to the matrix-degrading enzyme. As described in Section F below, kits containing these combinations and also articles of manufacture, such as containers, also are provided.

Thus, when desired, the activatable matrix-degrading enzyme is subjected to activating conditions in which the enzyme is exposed to an activator to generate an active enzyme. Exposure to an activator can be achieved in vitro or in vivo. For example, where an activatable enzyme and activator are separately provided, they can be administered together or separately. Where administered separately, the conditionally activatable matrix-degrading enzyme can be administered simultaneously, subsequently or intermittently from the activator. In another example, the matrix-degrading enzyme, in a lyophilized or concentrated liquid form, can be reconstituted with the activator just prior to use. In such an example, the mixture of the matrix-degrading enzyme and activator are administered together. Such methods of activation can be empirically determined by one of skill in the art, and may differ depending on the choice of enzyme and activator, and the method of treatment and treatment regime desired.

The activatable matrix-degrading enzyme can be provided in an article or manufacture alone or in combination with the activator. For example, if the enzyme is provided in combination with the activator, an article of manufacture can contain an enzyme, either lyophilized or in liquid form, in one compartment, and an activator in an adjacent compartment. The compartments can be separated by a dividing member. Such articles of manufacture are described elsewhere herein.

The combinations of matrix-degrading enzyme and activator also can further contain other agents, discussed in detail below. For example, in addition to the activator and matrix-degrading enzyme, combinations are provided containing one or more of a anesthetic, vasoconstrictor or dispersing agent.

E. Methods of Producing Nucleic Acids Encoding Matrix-Degrading Enzymes And Polypeptides Thereof Polypeptides of matrix-degrading enzymes set forth herein, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a desired matrix-degrading enzyme, such as from a cell or tissue source. Modified or variant matrix-degrading enzymes, can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. For example, exemplary heterologous signal sequences include, but are not limited to, human kappa IgG heterologous signal sequence set forth in SEQ ID NO:2. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:235) or Flag Tag (DYKDDDDK; SEQ ID NO:236).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the proenzyme polypeptide coupled to the native or heterologous signal sequence, as well as multiple copies thereof. The vectors can be selected for expression of the enzyme protein in the cell or such that the enzyme protein is expressed as a secreted protein. The proenzyme (i.e. zymogen) form of the enzyme can be purified for use as a activatable enzyme herein. Alternatively, upon secretion the prosegment can be cleaved catalytically or autocatalytically to generate a mature enzyme. If necessary, the enzyme can be purified such that the prosegment is removed from the preparation. Such mature forms, if inactive, also can be used herein as activatable enzyme either in a single chain or two-chain form.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bemoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in *Scientific American* 242:79-94 (1980)); plant expression vectors containing the nopaline synthetase promoter (Herrar-Estrella et al., *Nature* 303:209-213 (1984)) or the cauliflower mosaic virus 35S RNA promoter (Gardner et al., Nucleic Acids Res. 9:2871 (1981)), and the promoter of the photosynthetic enzyme ribulose bisphosphate carboxylase (Herrera-Estrella et al., Nature 310:115-120 (1984)); promoter elements from yeast and other fungi such as the Ga14 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., Cell 38:639-646 (1984); Ornitz et al., Cold Spring Harbor Symp. Quant. Biol. 50:399-409 (1986); MacDonald, Hepatology 7:425-515 (1987)); insulin gene control region which is active in pancreatic beta cells (Hanahan et al., Nature 315:115-122 (1985)), immunoglobulin gene control region which is active in lymphoid cells (Grosschedl et al., Cell 38:647-658 (1984); Adams et al., Nature 318:533-538 (1985); Alexander et al., Mol. Cell Biol. 7:1436-1444 (1987)), mouse mammary tumor virus control region which is active in testicular, breast, lymphoid and mast cells (Leder et al., Cell 45:485-495 (1986)), albumin gene control region which is active in liver (Pinckert et al., Genes and Devel. 1:268-276 (1987)), alpha-fetoprotein gene control region which is active in liver (Krumlauf et al., Mol. Cell. Biol. 5:1639-1648 (1985); Hammer et al., Science 235:53-58 1987)), alpha-1 antitrypsin gene control region which is active in liver (Kelsey et al., Genes and Devel. 1:161-171 (1987)), beta globin gene control region which is active in myeloid cells (Magram et al., Nature 315:338-340 (1985); Kollias et al., Cell 46:89-94 (1986)), myelin basic protein gene control region which is active in oligodendrocyte cells of the brain (Readhead et al., Cell 48:703-712 (1987)), myosin light chain-2 gene control region which is active in skeletal muscle (Shani, Nature 314:283-286 (1985)), and gonadotrophic releasing hormone gene control region which is active in gonadotrophs of the hypothalamus (Mason et al., Science 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of E. coli cells, include, for example, the pQE expression vectors (available from Qiagen, Valencia, Calif.; see also literature published by Qiagen describing the system). pQE vectors have a phage T5 promoter (recognized by E. coli RNA polymerase) and a double lac operator repression module to provide tightly regulated, high-level expression of recombinant proteins in E. coli, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of E. coli cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible E. coli lac operator, and the lac repressor gene; pET 12a-c, which contains the T7 promoter, T7 terminator, and the E. coli ompT secretion signal; and pET 15b and pET19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Expression

Matrix-degrading enzymes can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as E. coli, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Matrix-degrading enzymes also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

Generally, matrix-degrading enzymes are expressed in an inactive zymogen form. Zymogen conversion can be achieved by exposure to other proteases or to autocatalysis to generate a mature enzyme. Any form of an enzyme is contemplated herein, so long as it is inactive in the absence of an activator.

a. Prokaryotic Cells

Prokaryotes, especially E. coli, provide a system for producing large amounts of proteins. Transformation of E. coli is simple and rapid technique well known to those of skill in the art. Expression vectors for E. coli can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated APL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as matrix-degrading enzymes. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda*, *Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including matrix-degrading enzymes. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO-S cells (Invitrogen, Carlsbad, Calif., cat #11619-012) and the serum free EBNA-1 cell line (Pham et al., (2003) Biotechnol. Bioeng. 84:332-42.). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with agrobacterium-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce matrix-degrading enzymes. Because plants have different glycosylation patterns than mammalian cells, this can influence the choice of protein produced in these hosts.

3. Purification Techniques

Method for purification of polypeptides, including matrix-degrading enzymes or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Generally, matrix-degrading enzymes are expressed and purified to be in an inactive form (zymogen form) for subsequent activation as described in the systems and methods provided herein. In some applications, matrix-degrading enzymes are inactive in their mature form in the absence of an activator as described herein. Hence, following expression, mature forms can be generated by autocatalysis to remove the prosegment. For many enzymes, the autocatalysis requires the presence of the activator. If necessary, additional purification steps can be performed to remove the prosegment from the purified preparation. In some circumstances, such as for use as controls, expressed matrix-degrading enzymes can be purified into an active form, by autocatalysis to remove the prosegment or by addition of an activator. In such examples, autoactivation can occur during the purification process, or by incubating at room temperature for 24-72 hours. The rate and degree of activation is dependent on protein concentration and the specific enzyme, such that for example, a more dilute sample may need to be incubated at room temperature for a longer period of time. Activation can be monitored by SDS-PAGE (e.g., a 3 kilodalton shift) and by enzyme activity (cleavage of a fluorogenic substrate). Where an active enzyme is desired, typically, an enzyme is allowed to achieve >75% activation before purification.

Proteins, such as matrix-degrading enzymes, can be purified using standard protein purification techniques known in the art including but not limited to, SDS-PAGE, size fraction and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind matrix-degrading enzymes can be used in affinity purification. Expression constructs also can be engineered to add an affinity tag to a protein such as a myc epitope, GST fusion or $His_6$ and affinity purified with myc antibody, glutathione resin and Ni-resin, respectively. Purity can be assessed by any method known in the art including gel electrophoresis and staining and spectrophotometric techniques.

F. Preparation, Formulation and Administration of Activatable Matrix-Degrading Enzymes The pharmaceutical compositions provided herein contain activatable matrix-degrading enzymes provided in an inactive form. Also provided are compositions containing an activator. The compounds can be formulated into suitable pharmaceutical preparations such as solutions, suspensions, gels, tablets, dispersible tablets, pills, capsules, powders, sustained release formulations or elixirs, for oral, parenteral administrate, as well as transdermal patch preparation and dry powder inhalers. Typically, the compounds are formulated into pharmaceutical compositions using techniques and procedures well known in the art (see e.g., *Ansel Introduction to Pharmaceutical Dosage Forms*, Fourth Edition, 1985, 126).

A selected matrix-degrading enzyme is included in an amount sufficient that, when activated, exert a therapeutically useful effect in the absence of undesirable side effects on the patient treated. The composition containing the activatable matrix-degrading enzyme can include a pharmaceutically acceptable carrier. Therapeutically effective concentration can be determined empirically by testing the compounds in known in vitro and in vivo systems, such as the assays provided herein. The concentration of a selected matrix-degrading enzyme in the composition depends on absorption, inactivation and excretion rates of the complex, the physicochemical characteristics of the complex, the dosage schedule, and amount administered as well as other factors known to those of skill in the art. For example, it is understood that the precise dosage and duration of treatment is a function of the tissue being treated and may be determined empirically using known testing protocols or by extrapolation from in vivo or in vitro test data. It is to be noted that concentrations and dosage values may also vary with the age of the individual treated. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. The amount of a selected matrix-degrading enzyme to be administered for the treatment of a disease or condition, for example an ECM-mediated disease or condition such as cellulite or lymphedema, can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease. Exemplary dosages range from or about 10 μg to 100 mg, particularly 50 μg to 75 mg, 100 μg to 50 mg, 250 μg to 25 mg, 500 μg to 10 mg, 1 mg to 5 mg, or 2 mg to 4 mg. The particular dosage and formulation thereof depends upon the indication and individual. If necessary dosage can be empirically determined. Typically the dosage is administered for indications described herein in a volume of 1-100 ml, particularly, 1-50 ml, 10-50 ml, 10-30 ml, 1-20 ml, or 1-10 ml volumes following reconstitution, such as by addition of an activator. Typically, such dosages are from at or about 100 μg to 50 mg, generally 1 mg to 5 mg, in a 10-50 ml final volume.

A selected activator typically is provided as a buffered solution in an amount that, when exposed to the matrix-degrading enzyme, activates the matrix-degrading enzyme. Typically, the amount of activator in the buffer is one that temporarily alters the physiological amounts of that activator present in the interstitium to a level sufficient to temporarily activate the selected activatable matrix-degrading enzyme. For example, where acidic pH is the activating condition, the activator in the form of an acidic buffer composition contains at least one acid, that when administered to the ECM, together or separate from the matrix-degrading enzyme, temporarily lowers the pH of the ECM below physiological pH, i.e. below neutrality. As described elsewhere herein, the acidic buffer is one that has an effective pH range within the pH optima of the selected enzyme. Neutralization of the acidic buffer will occur upon administration due to the neutral pH environment of the interstitium, and is a function of the buffering capacity. Other buffered solutions also are contemplated herein depending on the selected activatable matrix-degrading enzyme and activator chosen. For example, buffers can be prepared at varying temperatures, or with varying amounts of salt, reducing agent, or metal ions. The buffered activator solution containing the low pH activating condition also can contain a pharmaceutically acceptable carrier or excipient.

A matrix degrading enzyme can be administered at once, or can be divided into a number of smaller doses to be administered at intervals of time. Selected matrix-degrading enzymes can be administered in one or more doses over the course of a treatment time for example over several hours, days, weeks, or months. In some cases, continuous administration is useful. It is understood that the precise dosage and course of administration depends on the methods and system of activation contemplated. For example, the matrix degrading enzyme can be administered together or separate from the activator. Typically, if administered together, the activator is exposed to the matrix-degrading enzyme just prior to use, for example, by reconstitution of a lyophilized powder. In other presentations, the activator can be a component of the AMDE formulation or can be mixed with a liquid-based dosage form of the AMDE. Also, the AMDE can be diluted with an appropriate diluent prior to mixing the activator. If administered separately, the matrix-degrading enzyme composition can be administered sequentially, simultaneously or intermittently from the activator preparation.

Also, it is understood that the precise dosage and duration of treatment is a function of the disease being treated and can be determined empirically using known testing protocols or by extrapolation from in vivo or in vitro test data. It is to be noted that concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered hourly, daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects).

Pharmaceutically acceptable compositions are prepared in view of approvals for a regulatory agency or other agency prepared in accordance with generally recognized pharmacopeia for use in animals and in humans. Compositions can take the form of solutions, suspensions, emulsion, gels, tablets, pills, capsules, powders, and sustained release formulations. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. The formulation should suit the mode of administration.

Pharmaceutical compositions can include carriers such as a diluent, adjuvant, excipient, or vehicle with which an enzyme or activator is administered. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as saline, lactose, sucrose, dextrose, Ringers lactate, dicalcium phosphate, or carboxymethylcellulose; a lubricant, such as magnesium stearate, calcium stearate and talc; and a binder such as starch, natural gums, such as gum acacia gelatin, glucose, molasses, polyinylpyrrolidine, celluloses and derivatives thereof, povidone, crospovidones and other such binders known to those of skill in the art. Suitable pharmaceutical excipients include starch, glucose, lactose, sucrose, maltose, mannose, trehalose, mannitol, sorbitol, gelatin, malt, rice, flour, chalk, silica gel, sodium stearate, glycerol monostearate, talc, sodium chloride, dried skim milk, glycerol, propylene glycol, water, and ethanol. A composition, if desired, also can contain minor amounts of wetting or emulsifying agents, or pH buffering agents, for example, acetate, sodium citrate, maleate, glycinate, histidine, succinate, lactate, cyclodextrin derivatives, sorbitan monolaurate, triethanolamine sodium acetate, triethanolamine oleate, poly ethylene glycol and other such agents.

Other excipients in the formulation can include oxidixing or reducing agents such as cysteine, oxidized glutathione or cysteine, reduced glutathione; surfactants such as polysorbate 80, polysorbate 20, pluronic (F68), or preservatives. As noted, for purposes herein, acidic buffering agents can be provided as activators, which generally are provided in combinations separate from the matrix-degrading enzyme until use.

Reducing agents can increase the activity of matrix-degrading enzymes, and therefore can be provided in formulations for administration. For example, a reducing agent is required to assay enzyme activity using a fluorogenic peptide substrate (see e.g. Example 25). Also, a reducing agent increases the activity of cathepsin L for substrates such as collagen, HSA and a PH20 composition designated rHuPH20 (see e.g. Example 26). Exemplary reducing agents include, but are not limited to, cysteine or TCEP (tris(2-carboxyethyl)phosphine). Generally, a reducing agent is not included in a liquid formulation for long term storage because this can enhance the auto degradation and make the formulation less stable. It is contemplated herein that a reducing agent is added to a liquid dosage form or is added to reconstitute a lyophilized form of an enzyme prior to use, generally immediately prior to use. For example, a lyophilized enzyme, such as cathepsin L, can be reconstituted with a diluent containing a reducing agent. Alternatively, an enzyme can be formulated as a lyophilized enzyme containing a reducing agent present in the formulation, so long as the resulting protein retains stability of one to two years. In such a formulation, the lyophilized enzyme is reconstituted in a suitable diluent without reducing agent. The amount of reducing agent can be empirically determined and is a function of the particular reducing agent. Exemplary amounts for single dosage administration are from about 1 mM to 30 mM, for example, 1 mM, 2 mM, 5 mM, 6 mM, 7 mM, 8 mM, 9 mM, 10 mM, 15 mM, 20 mM, 25 mM or 30 mM.

Formulations are provided for administration to humans and animals in unit dosage forms, such as tablets, capsules, pills, powders, granules, sterile parenteral solutions or suspensions, and oral solutions or suspensions, and oil water emulsions containing suitable quantities of the compounds or pharmaceutically acceptable derivatives thereof. Pharmaceutically therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Examples of unit dose forms include ampoules, vials and syringes and individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared.

Compositions can be formulated for administration by any route known to those of skill in the art including intramuscular, intravenous, intradermal, intralesional, intraperitoneal injection, subcutaneous, sub-epidermal, epidural, nasal, oral, vaginal, rectal, topical, local, otic, inhalational, buccal (e.g., sublingual), and transdermal administration or any route. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the nature of the disease, the progress of the disease, the severity of the disease the particular composition which is used. For purposes herein, it is desired that matrix-degrading enzymes and activator are administered so that they reach the interstitium of skin or tissues. Thus, direct administration under the skin, such as by sub-epidermal administration methods, is contemplated. These include, for example, subcutaneous, intradermal and intramuscular routes of administration. Thus, in one example, local administration can be achieved by injection, such as from a syringe or other article of manufacture containing a injection device such as a needle. Other modes of administration also are contemplated. Pharmaceutical composition can be formulated in dosage forms appropriate for each route of administration.

In one example, pharmaceutical preparation can be in liquid form, for example, solutions, syrups or suspensions. If provided in liquid form, the pharmaceutical preparation of an activatable matrix-degrading enzyme can be provided as a concentrated preparation to be diluted to a therapeutically effective concentration upon addition of the activator. The activator can be added to the preparation prior to administration, or the activator can be added simultaneously, intermittently or sequentially with the matrix-degrading enzyme preparation. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid).

In another example, pharmaceutical preparations can be presented in lyophilized form for reconstitution with water or other suitable vehicle before use. For example, the pharmaceutical preparations of matrix-degrading enzymes can be reconstituted with a solution containing an appropriate activator. Reconstitution of the preparation yields a mixture containing a therapeutically effective amount of matrix-degrading enzyme in a suitable activator, that can be administered together using any desired route of administration.

Administration methods can be employed to decrease the exposure of selected matrix-degrading enzymes to degradative processes, such as proteolytic degradation and immunological intervention via antigenic and immunogenic responses. Examples of such methods include local administration at the site of treatment. Pegylation of therapeutics has been reported to increase resistance to proteolysis, increase plasma half-life, and decrease antigenicity and immunogenicity. Examples of pegylation methodologies are known in the art (see for example, Lu and Felix, *Int. J.*

Peptide Protein Res., 43: 127-138, 1994; Lu and Felix, Peptide Res., 6: 142-6, 1993; Felix et al., Int. J. Peptide Res., 46: 253-64, 1995; Benhar et al., J. Biol. Chem., 269: 13398-404, 1994; Brumeanu et al., J Immunol., 154: 3088-95, 1995; see also, Caliceti et al. (2003) Adv. Drug Deliv. Rev. 55(10):1261-77 and Molineux (2003) Pharmacotherapy 23 (8 Pt 2):3S-8S). Pegylation also can be used in the delivery of nucleic acid molecules in vivo. For example, pegylation of adenovirus can increase stability and gene transfer (see, e.g., Cheng et al. (2003) Pharm. Res. 20(9): 1444-51).

1. Injectables, Solutions and Emulsions

Parenteral administration, generally characterized by injection, either subcutaneously, intramuscularly or intradermally is contemplated herein. Injectables can be prepared in conventional forms, either as liquid solutions or suspensions, solid forms suitable for solution or suspension in liquid prior to injection, or as emulsions. Suitable excipients are, for example, water, saline, dextrose, glycerol or ethanol. In addition, if desired, the pharmaceutical compositions to be administered may also contain an activator in the form of a solvent such as pH buffering agents, reducing or oxidizing agents, metal ion salts, or other such buffers. The pharmaceutical compositions also may contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins. Implantation of a slow-release or sustained-release system, such that a constant level of dosage is maintained (see, e.g., U.S. Pat. No. 3,710,795) is also contemplated herein. The percentage of active compound contained in such parenteral compositions is highly dependent on the specific nature thereof, as well as the activity of the compound and the needs of the subject.

Parenteral administration of the compositions generally includes sub-epidermal routes of administration such as intradermal, subcutaneous and intramuscular administrations. If desired, intravenous administration also is contemplated. Injectables are designed for local and systemic administration. For purposes herein, local administration is desired for direct administration to the affected interstitium. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile mulsions. The solutions may be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents, amino acids, peptides and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, parabens such as methyl- and propyl-p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylceluose, hydroxypropyl methylcellulose and polyvinylpyrrolidone. Emulsifying agents include Polysorbate 80 (TWEEN 80), polysorbate 20 (TWEEN 20), pluronic (F68). A sequestering or chelating agent of metal ions includes EDTA. Pharmaceutical carriers also include ethyl alcohol, polyethylene glycol and propylene glycol for water miscible vehicles and sodium hydroxide, hydrochloric acid, citric acid or lactic acid for pH adjustment.

The concentration of the pharmaceutically active compound is adjusted so that an injection provides an effective amount to produce the desired pharmacological effect. The exact dose depends on the age, weight and condition of the patient or animal as is known in the art. The unit-dose parenteral preparations are packaged in an ampoule, a vial or a syringe with a needle. The volume of liquid solution or reconstituted powder preparation, containing the pharmaceutically active compound, is a function of the disease to be treated and the particular article of manufacture chosen for package. For example, for the treatment of cellulite, it is contemplated that for parenteral injection the injected volume is or is about 10 to 50 milliliters. Generally, this volume represents the volume of activator and matrix-degrading enzyme where the two are administered together. Thus, in one example, a dual container or dual-chamber syringe is provided containing a lyophilized enzyme preparation separated from a second compartment containing 10 to 50 milliliters of activator. Following reconstitution of the enzyme with the activator, the mixture can be administered. All preparations for parenteral administration must be sterile, as is known and practiced in the art. The injectable formulation can be stored under appropriate conditions such as at or about −80° C., −40° C., −20° C., 2-8° C., 15° C., room temperature or controlled room temperature.

Lyophilized Powders

Of interest herein are lyophilized powders, which can be reconstituted for administration as solutions, emulsions and other mixtures. They may also be reconstituted and formulated as solids or gels.

The sterile, lyophilized powder is prepared by dissolving a compound of inactive enzyme in a buffer solution. The buffer solution may contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbital, fructose, corn syrup, xylitol, glycerin, glucose, sucrose, mannose, sorbitol, trehalose, mannitol, sorbitol, hydroxyethyl starch or other suitable agent, in a suitable buffer, such as citrate, sodium or potassium phosphate or other such buffer known to those of skill in the art. Other excipients that can be added include amino acids such as glycine, alanine, proline, amines such as betaines, trimethylamine N-oxide, and salts of ammonium, sodium or magnesium. Then, a selected enzyme is added to the resulting mixture, and stirred until it dissolves. The resulting mixture is sterile filtered or treated to remove particulates and to insure sterility, and apportioned into vials for lyophilization. Each vial will contain a single dosage (1 mg-1 g, generally 1-100 mg, such as 1-5 mg) or multiple dosages of the compound. The lyophilized powder can be stored under appropriate conditions, such as at about 4° C. to room temperature.

Reconstitution of this lyophilized powder with a buffer solution provides a formulation for use in parenteral administration. The solution chosen for reconstitution can be any buffer, but typically is a buffer containing the activator. The activator is chosen as a function of the enzyme to be reconstituted. For example, a lyophilized preparation of cathepsin L is reconstituted with an acidic buffer at about pH 5.5. For reconstitution about 1 µg-20 mg, preferably 10 µg-1 mg, more preferably about 100 µg is added per mL of buffer or other suitable carrier. The precise amount depends upon the indication treated and selected compound. Such amount can be empirically determined.

2. Topical Administration

Topical mixtures are prepared as described for the local and systemic administration. The resulting mixture may be a solution, suspension, emulsions or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compounds or pharmaceutically acceptable derivatives thereof may be formulated as aerosols for topical application, such as by inhalation (see, e.g., U.S. Pat. Nos. 4,044,126; 4,414,209; and 4,364,923, which describe aerosols for delivery of a steroid useful for treatment inflammatory diseases, particularly asthma). These formulations for administration to the respiratory tract can be in the form of an aerosol or solution for a nebulizer, or as a microfine powder for insufflation, alone or in combination with an inert carrier such as lactose. In such a case, the particles of the formulation will typically diameters of less than 50 microns, preferably less than 10 microns.

The compounds may be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in optionally buffered aqueous solution of, for example, 0.1 to 0.2M concentration with respect to the active compound. Formulations suitable for transdermal administration also can be delivered by iontophoresis (see, e.g., *Pharmaceutical Research* 3(6), 318 (1986)) and typically take the form of an optionally buffered aqueous solution of the active compound.

3. Compositions for Other Routes of Administration

Depending upon the condition treated other routes of administration, such as topical application, transdermal patches, oral and rectal administration are also contemplated herein. For example, pharmaceutical dosage forms for rectal administration are rectal suppositories, capsules and tablets for systemic effect. Rectal suppositories include solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases may be used. Agents to raise the melting point of suppositories include spermaceti and wax. Rectal suppositories may be prepared either by the compressed method or by molding. The typical weight of a rectal suppository is about 2 to 3 gm. Tablets and capsules for rectal administration are manufactured using the same pharmaceutically acceptable substance and by the same methods as for formulations for oral administration.

Formulations suitable for rectal administration can be provided as unit dose suppositories. These can be prepared by admixing the active compound with one or more conventional solid carriers, for example, cocoa butter, and then shaping the resulting mixture.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Pharmaceutical compositions also can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,610; 4,769,027; 5,059,595; 5,073,543; 5,120,548; 5,354,566; 5,591,767; 5,639,476; 5,674,533 and 5,733,566).

Various delivery systems are known and can be used to administer selected matrix-degrading enzymes, such as but not limited to, encapsulation in liposomes, microparticles, microcapsules, recombinant cells capable of expressing the compound, receptor mediated endocytosis, and delivery of nucleic acid molecules encoding selected matrix-degrading enzymes such as retrovirus delivery systems.

Hence, in certain embodiments, liposomes and/or nanoparticles also can be employed with administration of matrix-degrading enzymes. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Typically, liposomes are also prepared containing cholesterol to stabilize the nanoparticles. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 μm) should be designed using polymers able to be degraded in vivo. Biodegradable polyalkyl-cyanoacrylate nanoparticles that meet these requirements are contemplated for use herein, and such particles can be easily made.

4. Combination Therapies

Any of the activatable matrix-degrading enzymes and activator combinations described herein can be further co-formulated or co-administered together with, prior to, intermittently with, or subsequent to, other therapeutic or pharmacologic agents or procedures. Such agents include, but are not limited to, other biologics, small molecule compounds, dispersing agents, anesthetics, vasoconstrictors and surgery, and combinations thereof. For example, for any disease or condition, including all those exemplified above, for which other agents and treatments are available, selected activatable matrix-degrading enzyme and activator combination for such diseases and conditions can be used in combination therewith. In another example, a local anesthetic, for example, lidocaine can be administered to provide pain relief. In some examples, the anesthetic can be provided in combination with a vasoconstrictor to increase the duration of the anesthetic effects. Any of the pharmacological agents provided herein can be combined with a dispersion agent that facilitates access into the tissue of pharmacologic agents, for example, following subcutaneous administration. Such substances are known in the art and include, for example, soluble glycosaminoglycanase enzymes such as hyaluronan degrading enzymes, for example, members of the hyaluronidase glycoprotein family (see, e.g., U.S. Publication Nos. 20050260186 and 20060104968).

Compositions of activatable matrix-degrading enzymes provided herein can be co-formulated or co-administered with a local anesthesia. For example, where pH is provided as the activating condition, administration of a local anesthesia is desired to minimize pain associated with exposure to acidic pH. Anesthsias include short-acting and long-lasting local anesthetic drug formulations. Short-acting local anesthetic drug formulations contain lidocaine or a related local anesthetic drug dissolved in saline or other suitable injection vehicle. Typically, local anesthesia with short-acting local anesthetics last approximately 20-30 minutes. Exemplary anesthetics include, for example, non-inhalation local anesthetics such as ambucaines; amoxecaines; amylocalnes; aptocaines; articaines; benoxinates; benzyl alcohols; benzocaines; betoxycaines; biphenamines; bucricaines; bumecaines; bupivacaines; butacaines; butambens; butanilicaines; carbizocaines; chloroprocaine; clibucaines; clodacaines; cocaines; dexivacaines; diamocaines; dibucaines; dyclonines; elucaines; etidocaines; euprocins; fexicaines; fomocaines; heptacaines; hexylcaines; hydroxyprocaines; hydroxytetracaines; isobutambens; ketocaines; leucinocaines; lidocaines; mepivacaines; meprylcaines; octocaines; orthocaines; oxethacaines; oxybuprocaines; phenacaines; pinolcaines; piperocaines; piridocaines; polidocanols; pramocaines; prilocalnes; procaines; propanocaines; propipocaines; propoxycaines; proxymetacaines; pyrrocaines; quatacaines; quinisocaines; risocaines; rodocaines; ropivacaines; salicyl alcohols; suicaines; tetracaines; trapencaines; and trimecaines; as well as various other non-inhalation anesthetics such as alfaxalones; amolanones; etoxadrols; fentanyls; ketamines; levoxadrols; methiturals; methohexitals; midazolams; minaxolones; propanidids; propoxates; pramoxines; propofols; remifentanyls; sufentanyls; tiletamines; and zolamine. The effective amount in the formulation will vary depending on the particular patient, disease to be treated, route of administration and other considerations. Such dosages can be determined empirically.

Due to the short half-life of local anesthetics, it is often desirable to co-administer or co-formulate such anesthetics with a vasoconstrictor. Examples of vasoconstrictors include alpha adrenergic receptor agonists including catecholamines and catecholamine derivatives. Particular examples include, but are not limited to, levonordefrin, epinephrine and norepinephrine. For example, a local anesthetic formulation, such as lidocaine, can be formulated to contain low concentrations of epinephrine or another adrenergic receptor agonist such as levonordefrin. Combining local anesthetics with adrenergic receptor agonists is common in pharmaceutical preparations (see e.g., U.S. Pat. Nos. 7,261,889 and 5,976,556). The vasoconstrictor is necessary to increase the half-life of anesthetics. The vasoconstrictor, such as epinephrine, stimulates alpha-adrenergic receptors on the blood vessels in the injected tissue. This has the effect of constriction the blood vessels in the tissue. The blood vessel constriction causes the local anesthetic to stay in the tissue much longer, resulting in a large increase in the duration of the anesthetic effect.

Generally, a vasoconstrictor is used herein in combination with an anesthetic. The anesthetic agent and vasoconstrictor can be administered together as part of a single pharmaceutical composition or as part of separate pharmaceutical compositions so long as the vasoconstrictor acts to constrict the blood vessels in the vicinity of whether the anesthetic agent has been administered to result in a prolonging of anesthesia. In one example, the anesthetic agent and vasoconstrictor are administered together in solution. In addition, the anesthetic agent and vasoconstrictor can be formulated together or separate from the activatable matrix-degrading enzyme and activator. Single formulations are preferred. The anesthetic agent and vasoconstrictor can be administered by injection, by infiltration or by topical administration, e.g., as part of a gel or paste. Typically, the anesthetic agent and vasoconstrictor are administered by injection directly into the site to be anesthetized, for example, by subcutaneous administration. The effective amount in the formulation will vary depending on the particular patient, disease to be treated, route of administration and other considerations. Such dosages can be determined empirically. For example, exemplary amounts of lidocaine is or is about 10 mg to 1000 mg, 100 mg to 500 mg, 200 mg to 400 mg, 20 mg to 60 mg, or 30 mg to 50 mg. The dosage of lidocaine administered will vary depending on the individual and the route of administration. Epinephrine can be administered in amounts such as, for example, 10 µg to 5 mg, 50 µg to 1 mg, 50 µg to 500 µg, 50 µg to 250 µg, 100 µg to 500 µg, 200 µg to 400 µg, 1 mg to 5 mg or 2 mg to 4 mg. Typically, epinephrine can be combined with lidocaine in a 1:100,000 to 1:200,000 dilution, which means that 100 ml of anesthetic contains 0.5 to 1 mg of epinephrine. Volumes administered can be adjusted depending on the disease to be treated and the route of administration. It is contemplated herein that 1-1100 ml, 1-50 ml, 10-50 ml, 10-30 ml, 1-20 ml, or 1-10 ml, typically 10-50 ml of an anesthetic/vasoconstrictor formulation can be administered subcutaneously for the treatment of an ECM-mediated disease or condition, such as cellulite. The administration can be subsequently, simultaneously or intermittently with administration of an activatable matrix-degrading enzyme and activator.

Compositions of activatable matrix-degrading enzymes provided herein also can be co-formulated or co-administered with a dispersion agent. The dispersion agent also can be co-formulated or co-administered with other pharmacological agents, such as anesthetics, vasoconstrictors, or other biologic agents. Exemplary of dispersion agents are glycosaminoglycanases, such as hyaluronan degrading enzymes, for example, hyaluronidases, that open channels in the interstitial space through degradation of glycosaminoglycans. These channels can remain relatively open for a period of 24-48 hours depending on dose and formulation. Such channels can be used to facilitate the diffusion of exogenously added molecules such as fluids, small molecules, proteins (such as matrix degrading enzymes), nucleic acids and gene therapy vectors and other molecules less than about 500 nm in size. In addition, it is thought that the formation of such channels can facilitate bulk fluid flow within an interstitial space, which can in turn promote the dispersion or movement of a solute (such as a detectable molecule or other diagnostic agent, an anesthetic or other tissue-modifying agent, a pharmacologic or pharmaceutically effective agent, or a cosmetic or other esthetic agent) that is effectively carried by the fluid in a process sometimes referred to as "convective transport" or simply convection. Such convective transport can substantially exceed the rate and cumulative effects of molecular diffusion and can thus cause the therapeutic or other administered molecule to more rapidly and effectively perfuse a tissue. Furthermore, when an agent, such as a matrix degrading enzyme, anesthetic or other agent, is co-formulated or co-administered with a glycosaminoglycanase and both are injected into a relatively confined local site, such as a site of non-intravenous parenteral administration (e.g., intradermal, subcutaneous, intramuscular, or into or around other internal tissues, organs or other relatively confined spaces within the body), then the fluid associated with the administered dose can both provide a local driving force (i.e. hydrostatic pressure) as well as lower impedance to flow (by opening channels within the interstitial matrix), both of which could increase fluid flow, and with it convective transport of the therapeutic agent or other molecule contained within the fluid. As a result, the use of glycosaminoglycanases can have substantial utility for improving the bioavailability as well as manipulating other pharmacokinetic and/or pharmacodynamic characteristics of co-formulated or co-administered agents, such as matrix degrading enzymes.

a. Hyaluronan Degrading Enzymes

Exemplary of glycosaminoglycanases are hyaluronan-degrading enzymes. Hyaluronan degrading enzymes include any enzyme that degrades hyaluronan. Exemplary hyaluronan degrading enzymes include, but are not limited to hyaluronidases and particular chondroitinases and lyases that have the ability to cleave hyaluronan. Exemplary of hyaluronan degrading enzymes in the compositions, combinations and methods provided herein are soluble hyaluronan degrading enzymes. For example, exemplary of glycosaminoglycanases are hyaluronidases. Hyaluronan-degrading enzymes, such as hyaluronidases, are a family of enzymes that degrade hyaluronic acid. By catalyzing the hydrolysis of hyaluronic acid, a major constituent of the interstitial barrier, hyaluronidase lowers the viscosity of hyaluronic acid, thereby increasing tissue permeability.

Hyaluronan, also called hyaluronic acid or hyaluronate, is a non-sulfated glycosaminoglycan that is widely distributed throughout connective, epithelial, and neural tissues. Hyaluronan is an essential component of the extracellular matrix and a major constituent of the interstitial barrier. By catalyzing the hydrolysis of hyaluronan, hyaluronan degrading enzymes lower the viscosity of hyaluronan, thereby increasing tissue permeability and increasing the absorption rate of fluids administered parenterally. As such, hyaluronan degrading enzymes, such as hyaluronidases, have been used, for example, as spreading or dispersing agents in conjunction with other agents, drugs and proteins to enhance their dispersion and delivery.

Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating $\beta$-1$\rightarrow$4 and $\beta$-1$\rightarrow$3 glycosidic bonds. Hyaluronan chains can reach about 25,000 disaccharide repeats or more in length and polymers of hyaluronan can range in size from about 5,000 to 20,000,000 Da in vivo. Accordingly, hyaluronan degrading enzymes for the uses and methods provided include any enzyme having the ability to catalyze the cleavage of a hyaluronan disaccharide chain or polymer. In some examples the hyaluronan degrading enzyme cleaves the $\beta$-1$\rightarrow$4 glycosidic bond in the hyaluronan chain or polymer. In other examples, the hyaluronan degrading enzyme catalyze the cleavage of the 1-1$\rightarrow$3 glycosidic bond in the hyaluronan chain or polymer.

i. Hyaluronidases

There are three general classes of hyaluronidases: Mammalian-type hyaluronidases, (EC 3.2.1.35) which are endo-beta-N-acetylhexosaminidases with tetrasaccharides and hexasaccharides as the major end products; Bacterial hyaluronidases (EC 4.2.99.1), degrade hyaluronan and, and to various extents, chondroitin sulfates (CS) and dermatan sulfates (DS), which are endo-beta-N-acetylhexosaminidases that operate by a beta elimination reaction that yields primarily disaccharide end products; and Hyaluronidases (EC 3.2.1.36) from leeches, other parasites, and crustaceans that are endo-beta-glucuronidases that generate tetrasaccharide and hexasaccharide end products through hydrolysis of the $\beta$1-3 linkage.

1) Mammalian-Type Hyaluronidases

Mammalian-type hyaluronidases have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS:237, 266 and 272 and BH55 (U.S. Pat. Nos. 5,747,027 and 5,827, 721), sheep (ovis aries) (SEQ ID NO:252, 267, 271 and 273),yellow jacket wasp (SEQ ID NOS:238 and 239), honey bee (SEQ ID NO:240), white-facehornet (SEQ ID NO:241), paper wasp (SEQ ID NO:242), mouse (SEQ ID NOS:243-245, 257), pig (SEQ ID NOS:246, 247), rat (SEQ ID NOS:248-250, 256), rabbit (SEQ ID NO:251), orangutan (SEQ ID NO:253), cynomolgus monkey (SEQ ID NO:254), guinea pig (SEQ ID NO:255), and human hyaluronidases. Exemplary of hyaluronidases in the compositions, combinations and methods provided herein are soluble hyaluronidases.

There are six hyaluronidase-like genes in the human genome, HYAL1 (SEQ ID NO:262), HYAL2 (SEQ ID NO:263), HYAL3 (SEQ ID NO:264), HYAL4 (SEQ ID NO:265) and PH20/SPAM1 (SEQ ID NO:232). Among hyaluronidases, PH20 is the prototypical neutral active enzyme, while the others exhibit no catalytic activity towards hyaluronan or any known substrates, or are active only under pH conditions. The hyaluronidase-like enzymes can also be characterized by those which are generally locked to the plasma membrane via a glycosylphosphatidyl inositol anchor such as human HYAL2 and human PH20 (Danilkovitch-Miagkova, et al. (2003) Proc Natl Acad Sci USA. 100(8):4580-5), and those which are generally soluble such as human HYAL1 (Frost et al, (1997) Biochem Biophys Res Commun. 236(1):10-5). N-linked glycosylation of some hyaluronidases can be very important for their catalytic activity and stability. While altering the type of glycan modifying a glycoprotein can have dramatic affects on a protein's antigenicity, structural folding, solubility, and stability, many enzymes are not thought to require glycosylation for optimal enzyme activity. Hyaluronidases are, therefore, unique in this regard, in that removal of N-linked glycosylation can result in near complete inactivation of the hyaluronidase activity. For such hyaluronidases, the presence of N-linked glycans is critical for generating an active enzyme.

Hence, mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NO:267), bovine (SEQ ID NO:266) and human (SEQ ID NO:232).

Human PH20 (also known as sperm surface protein PH20) is naturally involved in sperm-egg adhesion and aids penetration by sperm of the layer of cumulus cells by digesting hyaluronic acid. The PH20 mRNA transcript (corresponding to nucleotides 1058-2503 of the sequence set forth in SEQ ID NO:224) is normally translated to generate a 509 amino acid precursor protein containing a 35 amino acid signal sequence at the N-terminus (amino acid residue positions 1-35) and a 19 amino acid GPI anchor at the C-terminus (corresponding to amino acid residues 491-509). The precursor sequence is set forth in SEQ ID NO:232. An mRNA transcript containing a mutation of C to T at nucleotide position 2188 of the sequence of amino acids set forth in SEQ ID NO:224 also exists and is a silent mutation resulting in the translated product set forth in SEQ ID NO: 232. The mature PH20 is, therefore, a 474 amino acid polypeptide set forth in SEQ ID NO:233). There are potential N-linked glycosylation sites required for hyaluronidases activity at N82, N166, N235, N254, N368, N393, N490 of human PH20 exemplified in SEQ ID NO: 232. Disulfide bonds form between the cysteine residues C60 and C351 and between C224 and C238 (corresponding to amino acids set forth in SEQ ID NO:232) to form the core hyaluronidase domain. However, additional cysteines are required in the carboxy terminus for neutral enzyme catalytic activity such that amino acids 36 to 464 of SEQ ID NO:232 contains the minimally active human PH20 hyaluronidase domain.

Bovine PH20 is a 553 amino acid precursor polypeptide (SEQ ID NO:266). Alignment of bovine PH20 with the human PH20 shows only weak homology, with multiple gaps existing from amino acid 470 through to the respective carboxy termini due to the absence of a GPI anchor in the bovine polypeptide (see e.g., Frost GI (2007) *Expert Opin. Drug. Deliv.* 4: 427-440). No clear GPI anchor is predicted in other PH20 species besides humans. For example, PH20 polypeptides produced from ovine and bovine exist as soluble forms. Though bovine PH20 exists very loosely attached to the plasma membrane, it is not anchored via a phospholipase sensitive anchor (Lalancette et al. (2001) *Biol Reprod.* 65(2):628-36). This unique feature of bovine hyaluronidase has permitted the use of the soluble bovine testes hyaluronidase enzyme as an extract for clinical use (Wydase™, Hyalase™).

2) Bacterial Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan degrading enzymes in microorganisms, including strains of *Arthrobacter, Bdellovibrio, Clostridium, Micrococcus, Streptococcus, Peptococcus, Propionibacterium, Bacteroides,* and *Streptomyces.* Particular examples of such enzymes include, but are not limited to *Arthrobacter* sp. (strain FB24) (SEQ ID NO:275), *Bdellovibrio bacteriovorus* (SEQ ID NO:276), *Propionibacterium acnes* (SEQ ID NO:277), *Streptococcus agalactiae* ((SEQ ID NO:278); 18RS21 (SEQ ID NO:279); serotype Ia (SEQ ID NO:280); serotype III (SEQ ID NO:281), *Staphylococcus aureus* (strain COL (SEQ ID NO:282); strain MRSA252 (SEQ ID NOS:283 and 284); strain MSSA476 (SEQ ID NO:285); strain NCTC 8325 (SEQ ID NO:286); strain bovine RF122 (SEQ ID NOS:287 and 288); strain USA300 (SEQ ID NO:289), *Streptococcus pneumoniae* ((SEQ ID NO:290); strain ATCC BAA-255/R6 (SEQ ID NO:291); serotype 2, strain D39/NCTC 7466 (SEQ ID NO:292), *Streptococcus pyogenes* (serotype M1) (SEQ ID NO:293); serotype M2, strain MGAS10270 (SEQ ID NO:294); serotype M4, strain MGAS10750 (SEQ ID NO:295); serotype M6 (SEQ ID NO:296); serotype M12, strain MGAS2096 (SEQ ID NOS:297 and 298); serotype M12, strain MGAS9429 (SEQ ID NO:299); serotype M28 (SEQ ID NO:300); *Streptococcus suis* (SEQ ID NOS:301-303); *Vibrio fischeri* (strain ATCC 700601/ES114 (SEQ ID NO:304)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607).

3) Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of β1→3-linkages between β-D-glucuronate and N-acetyl-D-glucosamine residues in hyaluronate. Exemplary hyaluronidases from leeches include, but are not limited to, hyaluronidase from Hirudinidae (e.g., *Hirudo medicinalis*), Erpobdellidae (e.g., *Nephelopsis obscura* and *Erpobdella punctata*,), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol Biol*. 124(3):319-26). An exemplary hyaluronidase from bacteria that has the same mechanism of action as the leech hyaluronidase is that from the cyanobacteria, *Synechococcus* sp. (strain RCC307, SEQ ID NO:305).

iI. Other Hyaluronan Degrading Enzymes

In addition to the hyaluronidase family, other hyaluronan degrading enzymes can be used in conjunction with the activatable matrix degrading enzymes in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem*. 243(7):1523-1535; Yang et al. (1985) *J. Biol. Chem*. 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol Chem*. 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem*. 272:9123-9130). A exemplary chondroitin-sulfate-ABC endolyases and chondroitin-sulfate-ABC exolyases include, but are not limited to, those from *Proteus vulgaris* and *Flavobacterium* heparinum (the *Proteus vulgaris* chondroitin-sulfate-ABC endolyase is set forth in SEQ ID NO: 306 (Sato et al. (1994) *Appl. Microbiol. Biotechnol*. 41(1): 39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS:307 and 308, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett*. 48(2): 121-4; Michelacci et al. (1976) *J. Biol. Chem*. 251:1154-8; Tsuda et al. (1999) *Eur. J. Biochem*. 262:127-133).

iii. Soluble Hyaluronan Degrading Enzymes

Soluble hyaluronan degrading enzymes, including soluble hyaluronidases can be used in the methods, combinations or compositions provided herein for co-administration or co-formulation with matrix degrading enzymes, activators, anesthetics, vasoconstrictors, other pharmacologic or therapeutic agents, or combinations thereof, to permit the diffusion into tissues. Soluble hyaluronan degrading enzymes include any hyaluronan degrading enzymes that exist in soluble form, including, but not limited to, hyaluronidases such as bovine PH20 and ovine PH20, allelic variants thereof and other variants. Also included among soluble hyaluronan degrading enzymes are any hyaluronan degrading enzymes that have been modified to be soluble. For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods is a soluble neutral active hyaluronidase.

Exemplary of a soluble hyaluronidase is PH20 from any species, such as any set forth in any of SEQ ID NOS:232, 233, 266, 251, 267, 255, 257,271-273 or truncated forms thereof lacking all or a portion of the C-terminal GPI anchor, so long as the hyaluronidase is soluble and retains hyaluronidase activity. Also included among soluble hyaluronidases are allelic variants or other variants of any of SEQ ID NOS:232, 233, 266, 251, 267, 255, 257, 271-273, or truncated forms thereof. Allelic variants and other variants are known to one of skill in the art, and include polypeptides having 60%, 70%, 80%, 90%, 91%, 92%, 93%, 94%, 95% or more sequence identity to any of SEQ ID NOS:232, 233, 266, 251, 267, 255, 257, 271-273, or truncated forms thereof.

Typically, for use in the compositions, combinations, and methods herein, a soluble human PH20 is used. Although PH20 from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

1) Soluble Human PH20

For example, soluble forms of recombinant human PH20 have been produced and can be used in the methods described herein for co-administration or co-formulation with matrix degrading enzymes, activators, anesthetics, vasoconstrictors, other pharmacologic or therapeutic agents, or combinations thereof, to permit the diffusion into tissues. The production of such soluble forms of PH20 is described in related application Ser. Nos. 11/065,716 and 11/238,171, and in Examples 12-15 below. Soluble forms include, but are not limited to, any having C-terminal truncations to generate polypeptides containing amino acid 1 to amino acid 347, 372, 394, 413, 430, 447, 467, 477, 478, 479, 480, 481, 482 and 483 of the sequence of amino acids set forth in SEQ ID NO:232. When expressed in mammalian cells, the 35 amino acid N-terminal signal sequence is cleaved during processing, and the mature form of the protein is secreted. Thus, the mature soluble polypeptides contain amino acids 36 to 347, 372, 394, 413, 430, 447, 467, 477, 478, 479, 480, 481, 482 and 483 of SEQ ID NO:232. Deletion mutants ending at amino acid position 477 to 483 (corresponding to the precursor polypeptide set forth in SEQ ID NO:232) exhibit higher secreted hyaluronidase activity than the full length GPI-anchored form. Hence, soluble forms include, but are not limited to, any having C-terminal truncations to generate polypeptides containing amino acid 1 to amino acid 442, 443, 444, 445, 446 and 447 of the sequence of amino acids set forth in any of SEQ ID NOS 226-231, respectively, or allelic or species variants or other variants thereof. Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

2) rHuPH20

Recombinant soluble forms of human PH20 have been generated and can be produced and purified using the methods described herein. The generation of such soluble forms of recombinant human PH20 are described in related application Ser. Nos. 11/065,716 and 11/238,171, and in Examples 12-15 below. Exemplary of such a polypeptide are those generated from a nucleic acid molecule encoding amino acids 1-482 set forth in SEQ ID NO:225. The generation, production and purification of this PH20 is described in Examples 12-15 below. Resulting purified rHuPH20 can be heterogeneous due to peptidases present in the culture medium upon production and purification. As produced in the culture medium there is heterogeneity at the C-terminus so that the product, called rHuPH20, includes a mixture of species that can include any one or more of SEQ ID NOS. 226-231 in various abundance. Generally soluble forms of PH20, such as rHuPH20, are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

Hyaluronan degrading enzymes, such as any hyaluronidase, in particular a soluble PH20 such as rHuPH20, can be administered by any suitable route as described elsewhere herein. Typically, administration is by parenteral administration, such as by intradermal, intramuscular, subcutaneous or intravascular administration. The compounds provided herein can be formulated for parenteral administration by injection, e.g., by bolus injection or continuous infusion. Formulations for injection can be presented in unit dosage form, e.g., in ampoules or in multi-dose containers, with an added preservative. The compositions can be suspensions, solutions or emulsions in oily or aqueous vehicles, and can contain formulatory agents such as suspending, stabilizing and/or dispersing agents. Alternatively, the active ingredient can be in powder form for reconstitution with a suitable vehicle, e.g., sterile pyrogen-free water or other solvents, before use. For example, provided herein are parenteral formulations containing an effective amount of soluble PH20, such as 10 Units to 500,000 Units, 100 Units to 100,000 Units, 500 Units to 50,000 Units, 1000 Units to 10,000 Units, 5000 Units to 7500 Units, 5000 Units to 50,000 Units, or 1,000 Units to 10,000 Units, generally 10,000 to 50,000 Units, in a stabilized solution or suspension or a lyophilized from. The formulations can be provided in unit-dose forms such as, but not limited to, ampoules, syringes and individually packaged tablets or capsules. The dispersing agent can be administered alone, or with other pharmacologically effective agents in a total volume of 1-100 ml, 1-50 ml, 10-50 ml, 10-30 ml, 1-20 ml, or 1-10 ml, typically 10-50 ml.

In one example of a combination therapy, it is contemplated herein that a anesthetic, vasoconstrictor and dispersion agent are co-administered or co-formulated with an activatable matrix-degrading enzyme and/or activator to be administered subsequently, simultaneously or intermittently therewith. An exemplary formulation is one containing lidocaine, epinephrine and a soluble PH20, for example, a soluble PH20 set forth in SEQ ID NO:226. Soluble PH20 can be mixed directly with lidocaine (Xylocalne), and optionally with epinephrine. The formulation can be prepared in a unit dosage form, such as in a syringe. For example, the lidocaine/epinephrine/soluble PH20 formulation can be provided in a volume, such as 1-100 ml, 1-50 ml, 10-50 ml, 10-30 ml, 1-20 ml, or 1-10 ml, typically 10-50 ml, prepackaged in a syringe for use.

In the combination therapies, the other pharmacologic agents, such as a lidocaine/epinephrine/soluble PH20 formulation, can be co-administered together with or in close temporal proximity to the administration of an activatable matrix-degrading enzyme (and activator). Typically it is preferred that an anesthetic and/or dispersion agent be administered shortly before (e.g. 5 to 60 minutes before) or, for maximal convenience, together with the pharmacologic agent. As will be appreciated by those of skill in the art, the desired proximity of co-administration depends in significant part on the effective half lives of the agents in the particular tissue setting, and the particular disease being treated, and can be readily optimized by testing the effects of administering the agents at varying times in suitable models, such as in suitable animal models.

iv. Modifications of Hyaluronan Degrading Enzymes to Improve Their Pharmacokinetic Properties Hyaluronan degrading enzymes can be modified to improve their pharmacokinetic properties, such as increasing their half-life in vivo and/or activities. The modification of hyaluronan degrading enzymes for use in the compositions, combinations and/or methods provided can include attaching, directly or indirectly via a linker, such as covalently or by other stable linkage, a polymer, such as dextran, a polyethylene glycol (pegylation(PEG)) or sialyl moiety, or other such polymers, such as natural or sugar polymers.

Pegylation of therapeutics is known to increase resistance to proteolysis, increase plasma half-life, and decrease antigenicity and immunogenicity. Covalent or other stable attachment (conjugation) of polymeric molecules, such as polyethylene glycol moiety (PEG), to the hyaluronan degrading enzyme thus can impart beneficial properties to the resulting enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan degrading enzyme, include natural and synthetic homopolymers, such as polyols (i.e. poly-OH), polyamines (i.e. poly-NH2) and polycarboxyl acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polypropylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose, carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran, pullulan and the like, have few reactive groups capable of cross-linking. Typically, the polymers are non-toxic polymeric molecules such as (m)polyethylene glycol (mPEG) which can be covalently conjugated to the hyaluronan degrading enzyme (e.g., to attachment groups on the protein surface) using a relatively simple chemistry.

Suitable polymeric molecules for attachment to the hyaluronan degrading enzyme include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., Advanced Drug Delivery Review 2002, 54: 459-476; Harris and Zalipsky, S (eds.) "Poly(ethyl ene glycol), Chemistry and Biological Applications" ACS Symposium Series 680, 1997; Mehvar et al., J. Pharm. Pharmaceut. Sci., 3(1):125-136, 2000; Harris, Nature Reviews 2:215 et seq. (2003); and Tsubery, J Biol. Chem 279(37): 38118-24, 2004). The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa.

Various methods of modifying polypeptides by covalently attaching (conjugating) a PEG or PEG derivative (i.e. "PEGylation") are known in the art (see e.g., U.S. Pat. No. 5,672,662 and U.S. Pat. No. 6,737,505; and U.S. Publication Nos. 2006/0104968 and 2004/0235734). Techniques for PEGylation include, but are not limited to, specialized linkers and coupling chemistries (see e.g., Harris, Adv. Drug Deliv. Rev. 54:459-476, 2002), attachment of multiple PEG moieties to a single conjugation site (such as via use of branched PEGs; see e.g., Veronese et al., Bioorg. Med. Chem. Lett. 12:177-180, 2002), site-specific PEGylation and/or mono-PEGylation (see e.g., Chapman et al., Nature Biotech. 17:780-783, 1999), and site-directed enzymatic PEGylation (see e.g., Sato, Adv. Drug Deliv. Rev., 54:487-504, 2002) (see, also, for example, Lu and Felix (1994) Int. J. Peptide Protein Res. 43:127-138; Lu and Felix (1993) Peptide Res. 6:142-6, 1993; Felix et al. (1995) Int. J. Peptide Res. 46:253-64; Benhar et al. (1994) J. Biol. Chem. 269: 13398-404; Brumeanu et al. (1995) J Immunol. 154:3088-95; see also, Caliceti et al. (2003) Adv. Drug Deliv. Rev. 55(10):1261-77 and Molineux (2003) Pharmacotherapy 23 (8 Pt 2):3S-8S). Methods and techniques described in the art can produce proteins having 1, 2, 3, 4, 5, 6, 7, 8, 9, 10 or more than 10 PEG or PEG derivatives attached to a single protein molecule (see e.g., U.S. Publication No. 2006/0104968).

Numerous reagents for PEGylation have been described in the art. Such reagents include, but are not limited to, N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butyraldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., J Bioactive Compatible Polymers 12:197-207, 1997; U.S. Pat. Nos. 5,672,662; 5,932,462; 6,495,659; 6,737,505; 4,002, 531; 4,179,337; 5,122,614; 5,183,550; 5,324,844; 5,446, 090; 5,612,460; 5,643,575; 5,766,581; 5,795,569; 5,808, 096; 5,900,461; 5,919,455; 5,985,263; 5,990,237; 6,113, 906; 6,214,966; 6,258,351; 6,340,742; 6,413,507; 6,420, 339; 6,437,025; 6,448,369; 6,461,802; 6,828,401; 6,858, 736; 2001/0021763; 2001/0044526; 2001/0046481; 2002/ 0052430; 2002/0072573; 2002/0156047; 2003/0114647; 2003/0143596; 2003/0158333; 2003/0220447; 2004/ 0013637; 2004/0235734; 2005/000360; 2005/0114037; 2005/0171328; 2005/0209416; EP 01064951; 0822199; WO 00176640; 0002017; 0249673; 9428024; and WO 0187925).

In one example, the hyaluronan degrading enzyme for use in the methods, compostions, and combinations provided is a soluble hyaluronidase that is PEGylated. In a particular example, the soluble hyaluronidase is a PEGylated PH20 hyaluronidase. In another particular example, the soluble hyaluronidase is PEGylated rHuPH20.

G. Packaging And Articles Of Manufacture Of Activatable Matrix-Degrading Enzymes Pharmaceutical compounds of selected matrix-degrading enzymes or nucleic acids encoding selected matrix-degrading enzymes, or a derivative or variant thereof can be packaged as articles of manufacture containing packaging material, a pharmaceutical composition which is effective for treating the disease or disorder, and a label that indicates that selected matrix-degrading enzyme or nucleic acid molecule is to be used for treating the disease or disorder. Combinations of a selected matrix-degrading enzyme, or derivative or variant thereof and an activator also can be packaged in an article of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. The articles of manufacture can include a needle or other injection device so as to facilitate administration (e.g. sub-epidermal administration) for local injection purposes. A wide array of formulations of the compounds and compositions provided herein are contemplated as are a variety of treatments for any ECM-mediated disease or disorder.

The choice of package depends on the matrix-degrading enzyme and activator, and whether such compositions will be packaged together or separately. In general, the packaging is non-reactive with the compositions contained therein such that activation of the activatable matrix-degrading enzyme does not occur prior to addition of the activator. In one example, the activatable matrix-degrading enzyme can be packaged as a mixture with the activator. Thus, for example, a lysosomal enzyme (e.g., cathepsin L) that requires low pH for activation can be packaged as a mixture with a buffered acidic solution.

In another example, the components can be packaged as separate compositions that, upon mixing, result in activation of the matrix-degrading enzyme. For example, a composition containing a matrix-degrading enzyme can be provided separately from, and for use with, a separate composition containing an activator, such as a buffered acidic solution. Thus, in such examples, the activatable matrix-degrading enzyme is packaged in a separate container from the activator, and activation is achieved by exposure to the activator at the users will. Exposure to the activator can occur at any time preceding administration by addition of the activator to the enzyme. For example, the container can have a single compartment containing the matrix-degrading enzyme and being amenable to addition of the activator by the user, for example through an opening in the compartment. Any container or other article of manufacture that is amenable to having a defining space for containment of the matrix-degrading enzyme and that is amenable to simple manipulation to permit addition of the final components necessary for activation is contemplated. The activator is added prior to use. Exposure to the activator also can occur following administration to the interstitium. For example, if heat is the activator, a matrix-degrading enzyme can be administered and the local injection site subjected to heat. In an alternate example, an acidic buffered solution can be administered to the interstitium followed by administration of a matrix-degrading enzyme, for example any requiring acidic pH for activation such as a cathepsin.

In other examples, the activatable matrix-degrading enzyme is packaged in a container with the activator such that activation of the matrix-degrading enzyme is amenable to activation by the user at will in the container. Generally, examples of such containers include those that have an enclosed, defined space that contains the matrix-degrading enzyme, and a separate enclosed, defined space containing the activator such that the two spaces are separated by a readily removable membrane which, upon removal, permits the components to mix and thereby react, resulting in activation of the protease. Any container or other article of manufacture is contemplated, so long as the matrix-degrading enzyme is separated from the activator. Exposure of the activator to the matrix-degrading enzyme is prior to use. For example, the physical separation means are those that are readily removed by the user, to permit mixing, resulting in activation of the enzyme. For example, an article of manufacture can contain a matrix-degrading enzyme in one compartment and an activator in an adjacent compartment. The compartments are separated by a dividing member, such as a membrane, that, upon compression of the article or manufacture ruptures permitting separated components to mix. For suitable embodiments see e.g., containers described in U.S. Pat. Nos. 3,539,794 and 5,171,081.

Following are some examples of the packaging requirements of various end uses of activatable matrix-degrading enzymes. These are offered as examples only and in no way are intended as limiting.

1. Single Chamber Apparatus

Among the simplest embodiments herein, are those in which the apparatus contains a single chamber or container and, if needed, ejection means. Single chamber housings or containers include any item in which a matrix-degrading enzyme is included in the container. The matrix-degrading enzyme is housed in the vessel in liquid phase or as a powder or other paste or other convenient composition. The activator component is introduced just prior to use. Prior to use the activator, typically provided as a buffered solution, is added and contacted with the matrix-degrading enzyme to permit mixing and/or reconstitution of the matrix-degrading enzyme. For example, when desired and depending on the matrix-degrading enzyme, a liquid containing $Ca^{2+}$, such as a mixture containing the $Ca^{2+}$ in an appropriate buffer, or an acidic buffered solution, or other solution containing an activating condition, is added to the container. Kits containing the item and the activator also are provided.

2. Dual Chamber Apparatus

An example of an apparatus contemplated for use herein is a dual chamber container. In general, this apparatus has two chambers or compartments thereby maintaining the matrix-degrading enzyme separate from the activator until activation is desired. The apparatus can include a mixing chamber to permit mixing of the components prior to dispensing from the apparatus. Alternatively, mixing can occur by ejection of the activator from one chamber into a second chamber containing the activatable matrix-degrading enzyme. For example, the activatable matrix-degrading enzyme can be provided in lyophilized form, and reconstitution can be achieved by ejection of the activator, such as an acidic buffered solution, from a first chamber into the second chamber containing the lyophilized enzyme.

In one embodiment, a dual chamber apparatus employs a mechanical pump mechanism in it operation. In such an example, the dispensing apparatus maintains the components in separate chambers. A pump mechanism operated to withdraw the contents from each chamber and into a mixing chamber, or from one chamber into the second chamber. Upon mixing, the mixed composition is activated by reaction of the components in the chambers. The pump mechanism can be manually operated, for example, by a plunger. Exemplary of such dual chamber apparatus include dual chamber syringes (see e.g., U.S. Pat. Nos. 6,972,005, 6,692, 468, 5,971,953, 4,529,403, 4,202,314, 4,214,584, 4,983,164, 5,788,670, 5,395,326; and International Patent Application Nos. WO2007006030 and WO2001047584).

Another embodiment of a dual chamber fluid dispensing apparatus contemplated for use herein takes the form of a compressible bottle or tube or other similar device. The device has two compartments within it that keep the components separated. The cap of the device can serve as a mixing chamber, a mixing chamber can be positioned between the two chambers and the cap, or mixing can be achieved within one of the chambers. The components are forced by compression from the separate compartments into the mixing chamber. They are then dispensed from the mixing chamber. For example, the mixed contents can be removed from the device by attaching a plunger/syringe apparatus to the dispensing end and withdrawing the contents therethrough. Such devices are known in the art (see e.g., International Patent Application. No. WO1994015848).

3. Kits

Selected matrix-degrading enzymes, activators and/or articles of manufacture thereof also can be provided as kits. Kits can include a pharmaceutical composition described herein and an item for administration provided as an article of manufacture. For example a selected matrix-degrading enzyme can be supplied with a device for administration, such as a syringe, an inhaler, a dosage cup, a dropper, or an applicator. The compositions can be contained in the item for administration or can be provided separately to be added later. Generally, kits contain an item with a matrix-degrading enzyme, and an activator composition containing the activating condition. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of the selected protease in a subject.

H. Methods of Assessing Activity of Matrix-Degrading Enzymes

1. Methods of Assessing Enzymatic Activity

Activatable matrix-degrading enzymes can be tested for their enzymatic activity against known substrates. Activity assessment can be performed in the presence or absence of an activator. Activity assessment also can be performed under varying conditions, for example, by varying the amount of activator used for activation. In one example, pH profiles can be be performed to determine the relative activity of an enzyme under various pH conditions (see e.g., Dehrmann et al. (1995) *Arch. Biochm. Biophys.,* 324:93-98). Activity assessments can be performed on conditioned medium or other supernatants or on purified protein.

Enzymatic activity can be assessed by assaying for substrate cleavage using known substrates of the enzyme. The substrates can be in the form of a purified protein or provided as peptide substrates. For example, enzymatic activity of cathepsin L can be assessed by cleavage of purified proteins like Azocasein, collagen, elastin, human serum albumin and rHuPH20 either by incubating them individually with the ADME or as a mixture of two or more purified proteins. Cleavage of a purified protein by an enzyme can be assessed using any method of protein detection, including, but not limited to, HPLC, CE, Mass spectrometry, SDS-PAGE analysis, ELISA, Western blotting, immunohistochemistry, immunoprecipitation, NH2-terminal sequencing, and protein labeling.

The use of fluorogenic groups on the substrates facilitates detection of cleavage. For example, substrates can be provided as fluorogenically tagged tetrapeptides of the peptide substrate, such as an ACC- or 7-amino-4-methyl courmarin (AMC)-tetrapeptide. Other fluorogenic groups are known and can be used and coupled to protein or peptide substrates. These include, for example, 7-amino-4-methyl-2-quinolinone (AMeq), 2-naphthylamine (NHNap) and 7-amino-4-methylcoumarin (NHMec) and fluorescein-5-isothiocyanate (FITC) (Sarath et al. "Protease Assay Methods," in *Proteolytic Enzymes: A Practical Approach.* Ed. Robert J. Beynon and Judith S. Bond. Oxford University Press, 2001. pp. 45-76). Peptide substrates are known to one of skill in the art, as are exemplary fluorogenic peptide substrates. For example, exemplary substrates for cathepsin B include, N-OBZ-Phe-Val-Arg-p-NA, DNA-Phe-Arg-Nph-Leu, Z-Ala-Arg-Arg-F$^3$MCA, Z-Arg-Arg-MBNA, Z-Arg-Arg-NHMec, Z-Phe-Arg-NHMec, and Z-Leu-Arg-AMC and variations thereof such as with different fluorogenic groups. In another example, an exemplary substrate for cathepsin L includes Z-Phe-Arg-NHMec and Z-Leu-Arg-AMC, and Z-His-Arg-Tyr-Arg-AMC, and variations thereof such as with different fluorgenic groups. Thus, since cathepsin B and cathepsin L share the same substrate, for example, Z-Phe-Arg-NHMec and Z-Leu-Arg-AMC, activity assessment of cathepsin L can be performed in the presence of a specific inhibitor to cathepsin B. Exemplary of such an inhibitor is CA-074. This is exemplified in Example 9 herein. Enzymes assays to measure enzymatic activity by fluorescence intensity are standard, and are typically performed as a function of incubation time of the enzyme and substrate (see e.g., Dehrmann et al. (1995) *Arch. Biochem. Biophys.,* 324:93-98; Barrett et al. (1981) *Methods Enzymol.,* 80:536-561).

While detection of fluorogenic compounds can be accomplished using a fluorometer, detection can be accomplished by a variety of other methods well known to those of skill in the art. Thus, for example, when the fluorophores emit in the visible wavelengths, detection can be simply by visual inspection of fluorescence in response to excitation by a light source. Detection also can be by means of an image analysis system utilizing a video camera interfaced to a digitizer or other image acquisition system. Detection also can be by visualization through a filter, as under a fluorescence microscope. The microscope can provide a signal that is simply visualized by the operator. Alternatively, the signal can be recorded on photographic film or using a video analysis system. The signal also can simply be quantified in real time using either an image analysis system or a photometer.

Thus, for example, a basic assay for enzyme activity of a sample involves suspending or dissolving the sample in a buffer (at the pH and ionic strength optima of the particular protease being assayed) adding to the buffer a fluorogenic enzyme peptide indicator, and monitoring the resulting change in fluorescence using a spectrofluorometer at a specific temperature for incubation as shown in e.g., Harris et al., (1998) *J Biol Chem* 273:27364. The spectrofluorometer is set to excite the fluorophore at the excitation wavelength of the fluorophore and detect signal at the emission wavelength of the fluorophore. The fluorogenic enzyme indicator is a substrate sequence of a enzyme (e.g. of a protease) that changes in fluorescence due to a protease cleaving the indicator. Enzymatic activity is typically expressed as standard units/ml based on a calibration curve generated with varying concentration of the fluorogenic substrate, and specific activity is represented as units/mg protein.

2. Methods of Assessing ECM Degradation

The degradation of extracellular matrix proteins by matrix-degrading enzymes, including, but not limited to, those described above, such as cathepsin L, can be assessed in vitro or in vivo. Assays for such assessment are known to those of skill in the art, and can be used to test the activities of a variety of matrix-degrading enzymes on a variety of extracellular matrix proteins, including, but not limited to collagen (I, II, III and IV), fibronectin, vitronectin and proteoglycans.

a. In Vitro Assays

Exemplary in vitro assays include assays to assess the degradation products of extracellular matrix proteins following incubation with a matrix-degrading enzyme. In some examples, the assays detect a single, specific degradation product. In other examples, the assays detect multiple degradation products, the identity of which may or may not be known. Assessment of degradation products can be performed using methods well known in the art including, but not limited to, HPLC, CE, Mass spectrometry, SDS-PAGE analysis, ELISA, Western blotting, immunohistochemistry, immunoprecipitation, NH2-terminal sequencing, and protein labeling. Extracellular matrix degradation products can be visualized, for example, by SDS-PAGE analysis following incubation with matrix-degrading enzymes for an appropriate amount of time at an appropriate temperature. For example, collagen can be incubated with activated cathepsin L and subjected to SDS-PAGE using, for example, a 4-20% Tris/glycine gel to separate the products. Coomassie staining of the gel facilitates visualization of smaller degradation products, or disappearance of collagen bands, compared to intact collagen. Immunoblotting using, for example, a polyclonal Ig specific to the extracellular matrix protein also can be used to visualize the degradation products following separation with SDS-PAGE.

Assays that specifically detect a single product following degradation of an extracellular matrix protein also are known in the art and can be used to assess the ability of a matrix-degrading enzyme to degrade an extracellular matrix protein. For example, the hydroxyproline (HP) assay can be used to measure degradation of collagen. 4-hydroxyproline is a modified imino acid that makes up approximately 12% of the weight of collagen. HP assays measure the amount of solubilized collagen by determining the amount of HP in the supernatant following incubation with a matrix-degrading enzyme, such as activated cathepsin L (see e.g., Example 2, below, and Reddy and Enwemeka (1996) *Clinical Biochemistry* 29:225-229). Measurement of HP can be effected by, for example, calorimetric methods, high performance liquid chromatography, mass spectrometry and enzymatic methods (see e.g., Edwards et al., (1980) *Clin. Chim. Acta* 104:161-167; Green (1992) *Anal. Biochem.* 201:265-269; Tredget et al., (1990) *Anal. Biochem.* 190:259-265; Ito et al., (1985) *Anal. Biochem.* 151:510-514; Garnero et al. (1998) *J. Biol. Chem* 273:32347-32352).

The collagen source used in such in vitro assays can include, but is not limited to, commercially available purified collagen, bone particles, skin, cartilage and rat tail tendon. Collagenolytic activity of a matrix-degrading enzyme such as cathepsin L can be assessed by incubating the activated enzyme with an insoluble collagen suspension, followed by hydrolysis, such as with HCl. The amount of hydroxyproline derived from the solubilized (degraded) collagen can be determined by spectrophotometric methods, such as measuring the absorbance at 550 nm following incubation with Ehrlich's reagent. In some examples, the collagen source is rat or pig skin explant that is surgically removed from anesthetized animals and then perfused with first an acidic solution and then the matrix-degrading enzyme, such as cathepsin L (see e.g. Examples 3-4, below). HP levels in the perfusates can then be assessed. In a modification of this method, the effect of, for example, cathepsin L on the fibrous septae in the explants can be assessed (see e.g. Example 5). Briefly, following perfusion with the matrix degrading enzyme, the explants are cut into small pieces and embedded in paraffin and analyzed by microscopy following Masson's Trichrome staining for visualization of collagen. The number of collagen fibrous septae can be visualized and compared to tissue that has not been treated with a matrix degrading enzyme.

Assays to detect degradation of specific collagens also are known in the art. Such assays can employ immunological methods to detect a degradation product unique to the specific collagen. For example, the degradation of collagen I by some matrix-degrading enzymes releases telopeptides with different epitopes that can be detected using immunoassays. Such assays detect the cross-linked N-telopeptides (NTx) and the cross-linked C-telopeptides (CTx and ICTP), each of which contain unique epitopes. Typically, CTx assays utilize the CrossLaps (Nordic Biosciences) antibodies that recognize the 8 amino acid sequence EKAHD-β-GGR octapeptide, where the aspartic acid is in β-isomerized configuration, in the C-terminal telopeptide region of the α1 chain (Eastell (2001) Bone Markers: Biochemical and Clinical Perspectives, pg 40). Immunoassays to detect ICTP also are known in the art and can be used to detect degradation of collagen I (U.S. Pat. No. 5,538,853). In other examples, immunoassays, such as, for example, ELISAs, can be used to detect NTx following incubation of collagen type I with proteases such as Cathepsins K, S, L and B (Atley et al., (2000) *Bone,* 26:241-247). Other antibodies and assays specific for degraded collagens are known in the art and can be used to detect degradation by matrix-degrading enzymes. These include antibodies and assays specific for degraded collagen I (Hartmann et al (1990) *Clin. Chem.* 36:421-426), collagen II (Hollander et al (1994) *J. Clin. Invest.* 93:1722-1732), collagen III (U.S. Pat. No. 5,34,2756), and collagen IV (Wilkinson et al (1990) *Anal. Biochem.* 185:294-6).

b. In Vivo Assays

Assays to detect the in vivo degradation of ECM also are known in the art. Such assays can utilize the methods described above to detect, for example, hydroxyproline and N- and C-telopeptides and degraded collagens or other ECM in biological samples such as urine, blood, serum and tissue. Detection of degraded ECM can be performed following administration to the patient of one or more matrix-degrading enzymes. Detection of pyridinoline (PYD) and deoxypyridinoline (DPYD), also can be used to assess degradation of collagen. Also known as hydroxylysylpyridinoline and lysylpyridinoline, respectively, PYD and DPYD are the two nonreducible trivalent cross-links that stabilize type I collagen chains and are released during the degradation of mature collagen fibrils. Pyridinoline is abundant in bone and cartilage, whereas deoxypyridinoline is largely confined to bone. Type III collagen also contains pyridinoline cross-links at the amino terminus. Total PYD and DPYD can be measured, for example, in hydrolyzed urine samples or serum by fluorimetric detection after reversed-phase HPLC (Hata et al (1995) *Clin. Chimica. Acta.* 235:221-227).

c. Non-Human Animal Models

Non-human animal models can be used to assess the activity of matrix-degrading enzymes. For example, non-human animals can be used as models for a disease or condition. Non-human animals can be injected with disease and/or phenotype-inducing substances prior to administration of matrix-degrading enzymes. Genetic models also are useful. Animals, such as mice, can be generated which mimic a disease or condition by the overexpression, under-expression or knock-out of one or more genes. For example, animal models are known in the art for conditions including, but not limited to, Peyronie's Disease (Davila et al. (2004) *Biol. Reprod.,* 71:1568-1577), tendinosis (Warden et al., (2006) *Br. J. Sports Med.* 41:232-240) and scleroderma (Yamamoto (2005) *Cur. Rheum. Rev.* 1: 105-109).

Non-human animals also can be used to test the activity of matrix-degrading enzymes in vivo in a non-diseased animal. For example, matrix-degrading enzymes can be administered to, non-human animals, such as, a mouse, rat or pig, and the level of ECM degradation can be determined. In some examples, the animals are used to obtain explants for ex vivo assessment of ECM degradation, such as that described above and in Examples 3-5, below. In other examples, ECM degradation is assessed in vivo. In one example, collagen degradation of the skin of anesthetized rats is assessed (see e.g. Example 6 below). Briefly, a matrix degrading enzyme, such as cathepsin L in a buffer with a pH of 5, is perfused via insertion of a needle into the dermal layer of the skin of the tail. Perfusate fractions are collected from the tail skin and analyzed for collagen degradation by hydroxyproline analysis. Other methods can be used to detect degradation including, but not limited to, any of the assays described above, such as immunoassays to detect specific degradation products. The effect of administering an acidic solution, such as the buffer containing cathepsin L that facilitates optimal activity, to the skin also can be assessed in a non-human animal model (see e.g. Example 7). Dyes sensitive to pH change, such as phenol red, can be used for these purposes.

I. Exemplary Methods of Treating Diseases or Defects of ECM

The activatable matrix degrading enzymes provided herein can be used for treatment of any condition mediated by any one or more ECM components. This section provides exemplary uses of, and administration methods for, activatable matrix-degrading enzymes. These described therapies are exemplary and do not limit the applications of enzymes. Such methods include, but are not limited to, methods of treatment of any ECM condition or disease that is caused by excess, aberrant or accumulated expression of any one or more ECM component. Exemplary of diseases or conditions to be treated are any mediated by collagen, elastin, fibronectin, or a glycosaminoglycan such as a proteoglycan. For example, exemplary of collagen-mediated diseases or disorders include, but are not limited to, cellulite, Dupuytren's disease (also called Dupuytren's contracture), Peyronie's disease, frozen shoulder, chronic tendinosis or scar tissue of the tendons, localized scleroderma and lymphedema. It is within the skill of a treating physician to identify such diseases or conditions.

The particular disease or condition to be treated dictates the activatable matrix-degrading enzyme that is selected. For example, treatment of a collagen-mediated disease or disorder can be effected by administration of matrix-degrading enzyme that cleaves collagen. Such matrix-degrading enzymes are listed above in Table 3, and/or known to one of skill in the art. Activatable matrix-degrading enzymes, and systems and methods for activation can be chosen accordingly to treat a particular disease or condition. For example, cathepsins of the cysteine and aspartic families can be made temporally active by acidic pH conditions as described herein. Thus, in one example, a cathepsin that cleaves a collagen, for example, cathepsin L, can be administered in the presence of an activating condition, such as acidic pH, to treat a collagen-mediated disease or condition.

Treatment of diseases and conditions with activatable matrix-degrading enzymes can be effected by any suitable route of administration using suitable formulations as described herein including, but not limited to, subcutaneous injection, intramuscular, intradermal, oral, and topical and transdermal administration. As described above, a route of administration of activatable matrix-degrading enzymes typically is chosen that results in administration under the skin directly to the affected site. Exemplary of such routes of administration include, but are not limited to, subcutaneous, intramuscular, or intradermal.

If necessary, a particular dosage and duration and treatment protocol can be empirically determined or extrapolated. For example, exemplary doses of recombinant and native active matrix-degrading enzymes or activatable matrix-degrading enzymes can be used as a starting point to determine appropriate dosages. Dosage levels can be determined based on a variety of factors, such as body weight of the individual, general health, age, the activity of the specific compound employed, sex, diet, time of administration, rate of excretion, drug combination, the severity and course of the disease, and the patient's disposition to the disease and the judgment of the treating physician. The amount of active ingredient that can be combined with the carrier materials to produce a single dosage form will vary depending upon the particular matrix-degrading enzyme, the host treated, the particular mode of administration, and the activating condition required for activation, and/or the predetermined or length of time in which activation is desired. The pharmaceutical compositions typically should provide a dosage of from about 1 µg/ml to about 20 mg/ml. Generally, dosages are from or about 10 µg/ml to 1 mg/ml, typically about 100 µg/ml, per single dosage administration. It is understood that the amount to administer will be a function of the activatable matrix-degrading enzyme and the activating condition chosen, the indication treated, and possibly side effects that will be tolerated. Dosages can be empirically determined using recognized models for each disorder. Also, as described elsewhere herein, activatable matrix-degrading enzymes can be administered in combination with other agents sequentially, simultaneously or intermittently. Exemplary of such agents include, but are not limited to, lidocaine, epinephrine, a dispersing agent such as hyaluronidase and combinations thereof.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms.

Descriptions of the involvement of collagen to collagen-mediated diseases or conditions is provided below as an example of the role of ECM components in diverse disease and conditions. Such descriptions are meant to be exemplary only and are not limited to a particular activatable matrix-degrading enzyme or to a particular ECM-mediated diseases or conditions. One of skill in the art can select an activatable matrix-degrading enzyme and activating condition for activation thereof, to be used in the treatment of any desired ECM-mediated disease, based on the ability of a particular enzyme to cleave or degrade an ECM component involved in the particular disease or condition. The particular treatment and dosage can be determined by one of skill in the art. Considerations in assessing treatment include, for example, the disease to be treated, the ECM component involved in the disease, the severity and course of the disease, whether the activatable matrix-degrading enzyme is administered for preventive or therapeutic purposes, previous therapy, the patient's clinical history and response to therapy, and the discretion of the attending physician.

1. Collagen-Mediated Diseases or Conditions

Collagen is a major structural constituent of mammalian organisms and makes up a large portion of the total protein content of the skin and other parts of the animal body. Numerous diseases and conditions are associated with excess collagen deposition, for example, due to erratic accumulation of fibrous tissue rich in collagen or other causes. Collagen-mediated diseases or conditions (also referred to as fibrotic tissue disorders) are known to one of skill in the art (see e.g., published U.S. Application No. 20070224183; U.S. Pat. Nos. 6,353,028; 6,060,474; 6,566,331; 6,294,350). Excess collagen has been associated with diseases and conditions, such as, but not limited to, fibrotic diseases or conditions resulting in scar formation, cellulite, Dupuytren's syndrome, Peyronie's disease, frozen shoulder, localized scleroderma, lymphedema, Interstitial cystitis (IC), Telangrectase, Barrett's metaplasia, Pneumatosis cytoides intestinalis, collagenous colitis. For example, disfiguring conditions of the skin, such as wrinkling, cellulite formation and neoplastic fibrosis result from excessive collagen deposition, which produces unwanted binding and distortion of normal tissue architecture.

Activatable matrix-degrading enzymes described herein, including but not limited to cathepsin L, can be used to treat collagen-mediated diseases or conditions. Exemplary of activatable matrix degrading enzymes for treatment of diseases and conditions described herein are those that are active at neutral pH, and require sustained acidic conditions for activity. For example, temporary acidification of the extracellular matrix, such as the skin interstitium, can be achieved by infusing a buffered acidic solution directly at the affected site. In one example, a buffered acid solution can be administered via sub-epidermal administration, i.e. under the skin, such that administration is effected directly at the site where ECM components are present and accumulated. Other methods of activation can be employed, and are known to one of skill in the art in view of the descriptions herein.

a. Cellulite

Activatable matrix-degrading enzymes, such as those described herein, including cathepsin L, can be used to treat cellulite. In normal adipose tissues, a fine mesh of blood vessels and lymph vessels supplies the tissue with necessary nutrients and oxygen, and takes care of the removal of metabolized products. For example, triglycerides are stored in individual adipocytes that are grouped into capillary rich lobules. Each fat lobule is composed of adipocytes. Vertical strands of collagen fibers named fibrous septae separate the fat lobules and tether the overlying superficial fascia to the underlying muscle.

Cellulite is typically characterized by dermal deterioration due to a breakdown in blood vessel integrity and a loss of capillary networks in the dermal and subdermal levels of the skin. The vascular deterioration tends to decrease the dermal metabolism. This decreased metabolism hinders protein synthesis and repair processes, which results in dermal thinning. The condition is further characterized by fat cells becoming engorged with lipids, swelling and clumping together, as well as excess fluid retention in the dermal and subdermal regions of the skin. The accumulation of fat globules or adipose cells creates a need for a bigger blood supply to provide extra nourishment. To provide the blood to tissues, new capillaries are formed, which release more filtrate resulting in a saturation of tissues with interstitial fluid causing edema in the adipose tissues. Abundant reticular fibers in the interstitial tissues accumulate and thicken around the aggregated adipose cells; they form capsules or septa, which gradually transform into collagen fibers and are felt as nodules. The formation of these septa further occludes fat cells. Collagen fibers are also laid down in the interstitial tissue spaces, rendering the connective tissue sclerotic (hard).

Hence, as the condition further progresses, hard nodules of fat cells and clumps of fats surrounded by septa form in the dermal region. This leads to the surface of the skin displaying considerable heterogeneity and being characterized as having a "cottage cheese" or "orange peel" appearance. The dimpling occurs when the fibrous septae that connect the skin to the dermis and deeper tissue layers tighten and pull in the skin. Thus, the "orange peel" appearance of cellulite is due to the deformation of the fat lobules as a result of outward forces on the adipose tissue. The fat lobules can be large, for example up to 1 cm wide, and easily protrude into the overlying dermis, causing a visible deformation on the surface of the skin. The net result is the undulating appearance of the outer skin as the fat pushes upwards. As the connective septae run in the same direction as these outward forces, they can offer no counter force to keep the adipose from protruding into the dermis.

Cellulite is more prevalent among females than males. The prevalence of cellulite is estimated between 60% and 80% of the female population and its severity tends to worsen with obesity. Recently, a published study showed by in vivo magnetic resonance imaging that women with cellulite have a higher percentage of perpendicular fibrous septae than women without cellulite or men (Querleux et al., (2002) *Skin Research and Technology*, 8:118-124). Cellulite occurs most often on the hips, thighs and upper arms. For example, premenopausal females tend to accumulate fat subcutaneously, primarily in the gluteal/thigh areas where cellulite is most common. Clinically, cellulite is accompanied by symptoms that include thinning of the epidermis, reduction and breakdown of the microvasculature leading to subdermal accumulations of fluids, and subdermal agglomerations of fatty tissues.

b. Dupuytren's Disease

Activatable matrix-degrading enzymes, such as those described herein, can be used to treat Dupuytren's syndrome (also called Dupuytren's contracture). Dupuytren's contracture (also known as Morbus Dupuytren) is a fixed flexion contracture of the hand where the fingers bend towards the palm and cannot be fully extended. A similar lesion sometimes occurs in the foot. The connective tissue within the hand becomes abnormally thick and is accompanied by the presence of nodules containing fibroblasts and collagen, particularly type III collagen. The fibrous cord of collagen is often interspersed with a septa-like arrangement of adipose tissue. These present clinically as mattress-type "lumps" of varying sized and in Dupuytren's disease are termed nodules. This can cause the fingers to curl, and can result in impaired function of the fingers, especially the small and ring fingers. Dupuytren's disease occurs predominantly in men. It is generally found in middle aged and elderly persons, those of Northern European ancestry, and in those with certain chronic illnesses such as diabetes, alcoholism and smoking.

Dupuytren's disease is a slowly progressive disease that occurs over many years causing fixed flexion deformities in the metacarpophalangeal (MP) and proximal interphalangeal (PIP) joints of the fingers. The small and ring fingers are the most often affected. The disease progresses through three stages (Luck et al. (1959) *J. Bone Joint Surg.,* 41A:635-664). The initial proliferative stage is characterized by nodule formation in the palmar fascia in which a cell known as the myofibroblast appears and begins to proliferate. The involutional or mid-disease stage involves myofibroblast proliferation and active type III collagen formation. In the last or residual phase, the nodule disappears leaving acellular tissue and thick bands of collagen. The ratio of type III collagen to type I collagen increases. Treatment of Dupuytren's disease with an activatable-matrix degrading enzyme is typically in the mid-disease and residual disease stages.

c. Peyronie's Disease

Activatable matrix-degrading enzymes, such as those described herein, can be used to treat Peyronie's disease. Peyronie's disease is a connective tissue disorder involving the growth of fibrous plaques in the soft tissue of the penis affecting as many as 1-4% of men. Collagen is the major component of the plaque in Peyronie's disease. Specifically, the fibrosing process occurs in the tunica albuginea, a fibrous envelope surrounding the penile corpora cavemosa. The pain and disfigurement associated with Peyronie's disease relate to the physical structure of the penis in which is found two erectile rods, called the corpora cavernosa, a conduit (the urethra) through which urine flows from the bladder, and the tunica which separates the cavernosa from the outer layers of skin of the penis. A person exhibiting Peyronie's disease will have formation(s) of plaque or scar tissue between the tunica and these outer layers of the skin (referred to as "sub-dermal" in this application). The scarring or plaque accumulation of the tunica reduces its elasticity causes such that, in the affected area, it will not stretch to the same degree (if at all) as the surrounding, unaffected tissues. Thus, the erect penis bends in the direction of the scar or plaque accumulation, often with associated pain of some degree. In all but minor manifestations of Peyronie's disease, the patient has some degree of sexual dysfunction. In more severe cases, sexual intercourse is either impossible, or is so painful as to be effectively prohibitive.

Empirical evidence indicates an incidence of Peyronie's disease in approximately one percent of the male population. Although the disease occurs mostly in middle-aged men, younger and older men can acquire it. About 30 percent of men with Peyronie's disease also develop fibrosis (hardened cells) in other elastic tissues of the body, such as on the hand or foot. Common examples of such other conditions include Dupuytren's contracture of the hand and Ledderhose Fibrosis of the foot.

d. Ledderhose Fibrosis

Activatable matrix-degrading enzymes, such as those described herein, can be used to treat Ledderhose fibrosis. Ledderhose fibrosis is similar to Dupuytren's disease and Peyronie's disease, except that the fibrosis due to fibroblast proliferation and collagen deposition occurs in the foot. Ledderhose disease is characterized by plantar fibrosis over the medial sole of the foot, and is sometimes referred to as plantar fibrosis.

e. Stiff Joints

Activatable matrix-degrading enzymes, such as those described herein, can be used to treat stiff joints, for example, frozen shoulder. Frozen shoulder (adhesive capsulitis) is a chronic fibrozing condition of the capsule of the joint characterized by pain and loss of motion or stiffness in the shoulder. It affects about 2% of the general population. Frozen shoulder results from increased fibroblast matrix synthesis. The sythesis is caused by an excessive inflammatory response resulting in the overproduction of cytokines and growth factors. Fibroblasts and myofibroblasts lay down a dense matrix of collagen in particular, type-I and type-III collagen within the capsule of the shoulder. This results in a scarred contracted shoulder capsule and causes joint stiffness.

Other examples of stiff joints include, but are not limited to, those caused by capsular contractures, adhesive capsulitis and arthrofibrosis, which result from musculoskeletal surgery. Such stiff joints can occur in joints, including, for example, joints of the knees, shoulders, elbows, ankles and hips. Like frozen shoulder, such joint diseases are caused by increased matrix synthesis and scar formation. The stiff joints inevitably can cause abnormally high forces to be transmitted to the articular cartilage of the affected area. Over time, these forces result in the development of degenerative joint disease and arthritis. For example, in arthrofibrosis and capsular contracture, fibroblasts form excessive amounts of matrix in response to local trauma, such as joint dislocation.

f. Existing Scars

Activatable matrix-degrading enzymes, such as those described herein, can be used to treat existing scars. Collagen is particularly important in the wound healing process and in the process of natural aging, where it is produced by fibroblast cells. In some cases, however, an exaggerated healing response can result in the production of copious amounts of healing tissue (ground substance), also termed scar tissue. For example, various skin traumas such as burns, surgery, infection, wounds and accident are often characterized by the erratic accumulation of fibrous tissue rich in collagen. There also is often an increased proteoglycan content. In addition to the replacement of the normal tissue that has been damaged or destroyed, excessive and disfiguring deposits of new tissue sometimes form during the healing process. The excess collagen deposition has been attributed to a disturbance in the balance between collagen synthesis and collagen degradation. Including among scars are, for example, chronic tendinosis or scar tissue of the tendons, surgical adhesions, keloids, hypertrophic scars, and depressed scars.

i. Surgical Adhesions

Surgical adhesions are attachments of organs or tissues to each other through scar formation, which can cause severe clinical problems. The formation of some scar tissue after surgery or tissue injury is normal. In some cases, however, the scar tissue overgrows the region of injury and creates surgical adhesions, which tend to restrict the normal mobility and function of affected body parts. In particular, fibroblast proliferation and matrix synthesis is increased locally following such soft tissue injury. Adhesions then form when the body attempts to repair tissue by inducing a healing response. For example, this healing process can occur between two or more otherwise healthy separate structures (such as between loops of bowel following abdominal surgery). Alternately, following local trauma to a peripheral nerve, fibrous adhesions can form, resulting in severe pain during normal movement.

ii. Keloids

Keloids are scars of connective tissue containing hyperplastic masses that occur in the dermis and adjacent subcutaneous tissue, most commonly following trauma. Keloids generally are fibrous nodules that can vary in color from pink or red to dark brown. Keloids form in scar tissue as a result of overgrowth of collagen, which participates in wound repair. Keloid lesions are formed when local skin fibroblasts undergo vigorous hyperplasia and proliferation in response to local stimuli. The resulting lesion can result in a lump many times larger than the original scar. In addition to occur as a result of wound or other trauma, keloids also can form from piercing, pimples, a scratch, severe acne, chickenpox scarring, infection at a wound site, repeated trauma to an area, or excessive skin tension during wound closure.

iii. Hypertrophic Scars

Hypertrophic scars are raised scars that form at the site of wounds. They generally do not grow beyond the boundaries of the original wound. Like keloid scars, hypertrophic scars are a result of the body overproducing collagen.

iv. Depressed Scars

Depressed scars generally result from an inflammatory episode and are characterized by contractions of the skin, and leave a cosmetically displeasing and permanent scar. The most common example is scarring that occurs following inflammatory acne. The depression occurs as a normal consequence of wound healing, and the scar tissue causing the depression is predominantly made up of collagen resulting from fibroblast proliferation and metabolism.

g. Scleroderma

Activatable matrix-degrading enzymes, such as those described herein, can be used to treat scleroderma. Scleroderma is characterized by a thickening of the collagen. The more common form of the disease, localized scleroderma, affects only the skin, usually in just a few places, and sometimes the face. It is sometimes referred to as CREST syndrome. Symptoms include hardening of the skin and associated scarring. The skin also appears reddish or scaly, and blood vessels can be more visible. In more serious cases, scleroderma can affect the blood vessels and internal organs. Diffuse scleroderma can be fatal as a result of heart, kidney lung or intestinal damage, due to musculoskeletal, pulmonary, gastrointestinal, renal and other complications.

The condition is characterized by collagen buildup leading to loss of elasticity. The overproduction of collagen has been attributed to autoimmune dysfunction, resulting in accumulation of T cells and production of cytokines and other proteins that stimulate collagen deposition from fibroblasts.

h. Lymphedema

Activatable matrix-degrading enzymes, such as those described herein, can be used to treat lymphedema. Lymphedema is an accumulation of lymphatic fluid that causes swelling in the arms and legs. Lymphedema can progress to include skin changes such as, for example, lymphostatic fibrosis, sclerosis and papillomas (benign skin tumors) and swelling. Tissue changes associated with lymphedema include proliferation of connective tissue cells, such as fibroblasts, production of collagen fibers, an increase in fatty deposits and fibrotic changes. These changes occur first at the lower extremities, i.e. the fingers and toes. Lymphedema can be identified based on the degree of enlargement of the extremities. For example, one method to assess lymphedema is based on identification of 2-cm or 3-cm difference between four comparative points of the involved and uninvolved extremities.

i. Collagenous Colitis

Activatable matrix-degrading enzymes, such as those described herein, can be used to treat collagenous colitis. Collagenous colitis was first described as chronic watery diarrhea (Lindstrom et al. (1976) Pathol. Eur., 11:87-89). Collagenous colitis is characterized by collagen deposition, likely resulting from an imbalance between collagen production by mucosal fibroblasts and collagen degradation. It results in secretory diarrhea. The incidence of collagenous colitis is similar to primary biliary cirrhosis. The disease has an annual incidence of 1.8 per 100,000 and a prevalence of 15.7 per 100,000, which is similar to primary biliary cirrhosis (12.8 per 100,000) and lower than ulcerative colitis (234 per 100,000), Crohn's disease (146 per 100,000) or celiac disease (5 per 100,000). In patients with chronic diarrhea, about 0.3 to 5% have collagenous colitis. Collagenous colitis is an inflammatory disease resulting in increased production of cytokines and other agents that stimulate the proliferation of fibroblasts, resulting in increased collagen accumulation.

2. Spinal Pathologies

Diseases of the ECM or involving the ECM also include spinal pathologies, typically referred to as herniated disc or bulging discs, that can be treated using the methods herein. These include protruded and extruded discs. A protruded disc is one that is intact but bulging. In an extruded disk, the fibrous wrapper has torn and the nucleus pulposus (NP) has oozed out, but is still connected to the disk. While the NP is not the cause of the herniation, the NP contributes to pressure on the nerves causing pain. The NP contains hyaluronic acid, chondrocytes, collagen fibrils, and proteoglycan aggrecans that have hyaluronic long chains which attract water. Attached to each hyaluronic chain are side chains of chondroitin sulfate and keratan sulfate.

Herniated discs have been treated with chemonucleolytic drugs, such as chymopapain and a collagenase, typically by local introduction of the drug into the disc. A chemonucleolytic drug degrades one or more components of the NP, thereby relieving pressure. Chemonucleolysis is effective on protruded and extruded disks. Chemonucleolysis has been used treat lumbar (lower) spine and cervical (upper spine) hernias. For the methods herein, any enzyme that degrades a component of the NP and that is conditionally activated can be administered. These enzymes include cathepsin L. In addition, any of the hyaluronidases, collagenases, chondroitinases that are not conditionally activatable, can be modified to render them so. For example, temperature sensitive enzymes, as described herein, including modified MMPs, such as MMP-1 modified as described herein can be employed in the methods herein.

J. Examples

The following examples are included for illustrative purposes only and are not intended to limit the scope of the invention.

EXAMPLE 1

Preparation of Activated Recombinant Cathepsin-L

Histidine (His)-tagged purified recombinant human cathepsin-L was purchased from R&D systems (Minneapolis, Minn. Cat# 952-CY) and was formulated at a concentration of 0.9 mg/mL in 50 mM Acetate, pH 4.0, 100 mM NaCl. Aliquots of 500 µL were stored at −80° C. until they were used.

Concentration and buffer exchange were performed on stored aliquots before use. Briefly, 2 mL of 0.9 mg/mL cathepsin-L was thawed on ice and 500 µL transferred to 4 microcon centrifugal filter membrane tubes having a 30 KDa cut-off (Millipore; Bedford, Mass., Cat#42410). The microcon tubes were spun at 9000 rpm for 5 minutes resulting in a final volume of 50 µl. 450 µL of cold concentration buffer (100 mM Na-Formate pH 4, 100 mM NaCl, 5 mM DTT, 10 mM EDTA) was added to each micron tube. The addition of 5 mM DTT during processing converts cathepsin-L to a single chain protein of approximately 36 KDa as assessed by SDS-PAGE. The concentration and buffer exchange steps remove the inhibitory 10-16 KDa pro-peptide. In addition, the DTT and EDTA added during concentration and buffer exchange minimize proteolytic degradation of cathepsin-L. The centrifugation procedure was repeated three times. Tubes and concentration solutions were chilled to minimize degradation, since cathepsin-L is sensitive to temperature. After the final spin, the microcon tubes were inverted and the liquid was collected in the retentate cup by centrifugation at 5000 rpm for 5 minutes. The final volume recovered was 400 µL, resulting in a five-fold concentration. The concentrated cathepsin-L was aliquoted in volumes of 67 µL, which contained approximately 300 µg of activated enzyme. Aliquots were stored at −80° C., and thawed on ice prior to use.

Before use, cathepsin-L was formulated at its optimal pH of 5 by adding one aliquot to 3 mL of MES buffer solution (2-(N-morpholino)ethanesulfonic acid) at pH 5, resulting in a final concentration of 100 µg/mL of activated cathepsin-L. As a control, cathepsin-L was formulated in HEPES buffer at pH 7.4 where the enzyme is minimally active.

EXAMPLE 2

Hydroxyproline Assay

A hydroxyproline assay was used to measure collagen content changes in skin samples following perfusion with cathepsin-L. While the hydroxyproline content of other proteins is negligible, collagen contains hydroxyproline at a concentration of 8% (T V. Burjanadze, Hydroxyproline content and location in relation to collagen thermal stability. Biopolymers 18: 4931-4938 (2002)). The hydroxyproline (HP) assay used was a modification of the procedure of Reddy and Enwemeka (Clinical Biochemistry 29:225-229 (1996)).

In particular, the volumes of the reagents were modified for completion of the reaction in 8-well 0.2 mL strip tubes (Brandtech, Essex, Conn.) in a standard thermocycler (Eppenforf Mastercycler, Westbury, N.Y.). All steps including hydrolyzation, acidification and detection with Ehrlich's reagent were carried out in the 0.2 mL tubes. All chemicals were purchased from Sigma (St. Louis, Mo.). Briefly, perfusate samples from perfusion experiments were extracted by precipitation with 5 volumes of 200 proof ethanol and centrifuged. The volumes of perfusate collected were measured using 1 mL or 200 µL pipettes. The perfusates were transferred to labeled 15 mL conical centrifuge tubes. The ethanol perfusate mixtures were stored in a −80° C. freezer for 30 minutes before being centrifuged at 3000 rpm for 10 minutes in an Eppendorf swinging bucket centrifuge. Following centrifugation, the precipitate was dissolved in 150-400 µL of 2N NaOH depending on the size of the pellet. The supernatant was dried in a lyophilizer, and dissolved in 150-200 µL of 2N NaOH. Following dissolution in NaOH, samples were transferred to 8-well strip tubes at a volume of 200 µL or less per tube and hydrolyzed at 99° C. for 12 hours in a thermocycler to allow for complete hydrolysis of collagen and hydroxyproline release. Samples were acidified with concentrated HCl (5.2 µL of HCl per every 25 µL of hydrolyzed sample). 60 µL of Chloramine-T (Sigma; Cat# C9887) were added to an equal volume of acidified hydrolysate to complete hydroxyproline oxidation. After complete oxidation, 120 µL of Ehrlich's reagent (Sigma, Saint Louis, Mo., Cat# 39070(Fluka)) was added and incubated at 65° C. for 25 minutes, resulting in a purple color. The intensity of the coloration is dependent on the amount of hydroxyproline derived from the collagen released in the perfusate. Samples were read in the visible range at 550 nm in a Spectramax 2E plate reader (Molecular Devices, Sunnyvale, Calif.). A standard curve was established using purified hydroxyproline solution (Sigma, Saint Louis, Mo., Cat# H54409), and hydroxyproline content in skin samples were determined from the standard curve.

EXAMPLE 3

Degradation of Collagen by Perfusion of Ex Vivo Rat Skin Explants with Activated Cathepsin-L Skin explants (2 cm×2 cm) were surgically removed from the dorsolateral site of 3-month old male Sprague-Dawley rats (Harlan Sprague Dawley, Indianapolis, Ind.) anesthetized with 2% isofluorane. Explants were pinned down with needles to a Styrofoam pad glued to a 100 mm Petri dish and kept at 37° C. with a heating pad. Using an infusion pump (Thermo Orion, model M361, Boston, Mass.), 6 mL of a solution containing MES buffer (2-(N-morpholino-ethanesulfonic acid) at pH 5 and rHuPH20 at 2500 Units/mL (rHuPH20 Halozyrne internal manufacturing lot# 056-100; specific activity: 124,000 U/mL and protein content of 1.05 mg/mL) were first perfused for 35 minutes through the skin explants via a 27-gauge butterfly needle inserted into the dermal layer of the explants. After completion of the acidic perfusion, the skin explants were perfused for approximately 30 minutes with or without 100 µg/mL of activated cathepsin-L in MES buffer, pH 5 or control cathepsin-L in HEPES buffer, pH 7.4. Fractions were collected by aspirating with a 200 µL micropipette and collecting the contents in 1.5 mL Eppendorf tubes at time intervals of 5-10 minutes during the entire perfusion procedure. The fractions were pooled in Eppendorf tubes and rapidly frozen until hydroxyproline (HP) analysis was performed as described in Example 2.

The results of three different experiments show that HP levels were significantly increased only in samples perfused with activated cathepsin-L at the optimum pH of 5. Average (n=3) HP levels increased from less than 1 µg/mL of perfusate at approximately 6 minutes to more than 30 µg/mL of perfusate at approximately 30 minutes. None or little HP was measured in the perfusates from infusions with MES buffer pH 5 only; HEPES buffer pH 7.4 only; and control cathepsin-L at pH 7.4.

EXAMPLE 4

Degradation of Collagen by Perfusion of Ex Vivo Pig Skin Explants with Activated Cathepsin-L Three-month old female Yorkshire pigs (S and S Farm, Ramona, Calif.) were fasted overnight and anesthetized by intramuscular injection of Ketamine (20 mg/kg)/Xylazine (2 mg/kg) and atropine (0.04 mg/kg). Animals were then intubated and anesthesia was maintained with 2% inhaled isoflurane (Baxter, Deerfield, Ill.) in oxygen (Airgas, San Diego, Calif.). Whole skin explants (5 cm×5 cm) were surgically removed from the back of the animals, placed in phosphate buffered saline (PBS) at 4° C., and used within 2 hours following excision. Perfusion of explants and hydroxyproline analysis were carried out essentially as described in Example 3, except that the pig skin explants were perfused with MES buffer pH 5, or MES buffer pH 5 containing 100 µg/ml of cathepsin-L without PH20. Initially, explants were perfused with 6 mL of MES buffer pH 5 for approximately 30 minutes, and fractions were collected every 5-10 minutes. Thereafter, explants were perfused with 3 mL of 100 µg/ml of cathepsin-L in MES buffer pH 5 or buffer alone as a control collected every 5 minutes for approximately 25 minutes. HP analysis showed a time-dependent increase in HP levels in the samples perfused with cathepsin-L. No detectable HP could be measured in samples perfused with MES buffer pH 5 without cathepsin-L. Highest levels of HP were measured at time 15 minutes. HP levels measured at 25 minutes were similar to those measured at 15 minutes.

EXAMPLE 5

Decrease in Fibrous Septae in the Subcutaneous Space by Perfusion of Pig Explants with Activated Cathepsin-L Pig skin explants were processed essentially as described in Example 4 by perfusion with MES buffer, pH 5 containing 2500 U/mL rHuPH20, at a rate of 0.17 mL per minute for 30 minutes, followed by perfusion with 3 mL of 100 µg/ml cathepsin-L in MES buffer pH 5 without rHuPH20 at 0.12 mL/min for 25 minutes. Following infusion with cathepsin-L, the explants were trimmed into small pieces that were fixed in 4% buffered formalin overnight. Control untreated pig explants were processed similarly. Tissues were washed in PBS, dehydrated in graded ethanol and xylene solutions, and embedded in paraffin. Blocks were cut in 4 µm thin sections that were transferred to microscope slides and stained with Masson's Trichrome staining for visualization of collagen. Briefly, sections were deparaffinized, hydrated in distilled water and treated with mordant in Bouin's solution (Sigma, Cat #HT10-132) for 15 to 30 minutes at 56° C. The sections were cooled and washed in running water until the yellow color disappeared and rinsed in distilled water. The sections were then stained in Weigert's Iron Hematoxylin Working solution (Sigma Cat # HT107 and HT109) for 5 minutes and washed in running water for 10 minutes. Sections were rinsed in deionized water for 5 minutes and placed in Biebrich Scarlet-Acid Fuchsin (Sigma, Cat # HT151) for 5 minutes. The sections were transferred to Working Phosphotungstic/Phosphomolybdic Acid solution (Sigma Cat # HT152 and HT153) and finally stained in Aniline Blue Solution (Sigma Cat # HT154) for 5 minutes and differentiated in 1% Acetic Acid for 2 minutes. Sections were rinsed in distilled water, dehydrated in 95% alcohol and absolute alcohol, and cleared in xylene with two changes. Sections were mounted and observed in a Nikon inverted microscope. Images were obtained using a 20× objective in a Nikon fluorescent microscope coupled to a camera scanner (Diagnostic Instrument Inc., Sterling Heights, Mich.) containing the SPOT advance imaging program.

The hypodermis predominantly contains adipose tissue. Dense connective tissue strands made of collagen fibrous septae extend from the dermis deep into the hypodermis and anchor the skin to underlying structures. The histology results shows that fibrous septae separating the fat cell chambers are visible throughout the hypodermis in the non-treated sample. Following treatment with cathepsin-L in MES buffer, pH 5, the number of collagen fibrous septae was substantially lower than in untreated samples, indicating that treatment with cathepsin-L dramatically alters the collagen network organization in the hypodermis.

EXAMPLE 6

A. Collagen Degradation in the Skin of Live Anesthetized Rats

Perfusion experiments were performed on three month old male Sprague-Dawley rats (Harlan Sprague-Dawley, Inc. Indianapolis, Ind.) kept under 2% isoflurane anesthesia. Perfusion experiments were performed using cathepsin-L at pH 5, and as a control for specificity, in HEPES buffer at pH 7.4. Briefly, using a infusion pump, about 15 mL of a solution containing either 25 mM MES buffer pH 5, or 25 mM HEPES buffer pH 7.4, and 2500 Units/ml of rHuPH20 (Halozyme internal manufacturing lot # 056-100 with specific activity of 124,000 U/mL and protein content of 1.05 mg/mL), were first perfused for approximately 60 minutes via the tail skin using a 27-gauge butterfly needle inserted into the dermal layer of the skin. Thereafter a 3 mL solution containing cathepsin-L or buffer control was perfused for 25 min. Cat-L containing perfusion solutions contained 100 µg/mL of activated Cat-L either at its optimum pH of 5 in 5 mM MES or at the control pH of 7.4 in 20 mM HEPES. The ionic strength of pH 5 buffer was reduced from 25 mM to 5 mM to facilitate neutralization of the pH by the local tissue environment and thereby limit the spread of the active enzyme. In case of Cat-L in HEPES buffer at pH 7.4 an ionic strength of at least 20 mM was maintained to ensure that the added Cat-L, activated and formulated in a high ionic strength buffer at pH 4, would not substantially alter the pH of the HEPES buffer (pH7.4). A small aliquot of the Cat-L added to 20 mM HEPES pH 7.4 was checked with pH paper to ensure that pH of the resulting solution, after Cat-L has been added, was indeed close to pH 7.4. Buffer control solutions used for perfusion were 5 mM MES pH 5 or 20 mM HEPES pH 7.4, with no added enzyme. Perfusate fractions were collected from the tail skin at regular time intervals, i.e at 20, 40 and 60 minutes during the initial perfusion and at 8 and 25 minutes during perfusion with Cat-L. The fractions were pooled in Eppendorf tubes and rapidly frozen to prevent further enzymatic action. Hydroxyproline analysis was performed as described in Example 2. The results show that HP could be measured only in the samples perfused with activated cathepsin-L. The highest levels of HP were measured in the 25 minute perfusate samples. There was no detectable HP in the samples perfused with MES buffer pH 5 only, or with HEPES buffer pH 7.4 only, or with cathepsin-L in HEPES buffer pH 7.4.

B. Cathepsin-L Treatment Leads to pH-dependent Collagen Degradation In Vitro

Cathepsins B, D, L and S and bacterial collagenase were assessed for degradation towards rat collagen at pH 5.0 and pH 8.0. Cathepsins B, D, L and S were purchased from R&D systems and each enzyme was activated based on individual specifications from the enzyme manufacture. Bacterial collagenase was purchased from Sigma Chemicals, and does not require activation. Soluble rat tail collagen Type I was digested for 1 hour at 37° C. by incubation with activated cathepsin B, D, L or S or bacterial collagenase, in the manufacture's specified buffers or in Tris pH 8.0 buffered saline, followed by SDS-Page gels and Coomassie Blue staining. Other cathepsins were not tested at pH 5, but at manufacture specified pH and buffer. The results show that cathepsin-L was the only enzyme that was active at pH 5.0, but not at pH 8.0. Cathepsins B, D and S showed some slight degradation of rat collagen at the manufacture specified pH and no degradation of rat collagen at pH 8.0, while bacterial collagenase degraded rat collagen at both pH 5.0 and pH 8.0.

EXAMPLE 7

A. Return to Neutrality Following Acidification of the Skin in a Live Rat

When a dilute aqueous acid solution is injected into the skin interstitium, the change in pH is temporary and the neutral skin pH is rapidly restored due to the significant buffering capacity of interstitium. Phenol red was used as a visual indicator of interstitial pH. The sodium salt of phenol red is widely used in cell culture medium to identify changes from neutral to acidic pH values. A solution of phenol red has a yellow color at a pH of 6.4 or below, orange color at pH 7.0, red color at pH 7.4 and above, and purple color at pH 7.8.

Three month old male Sprague-Dawley rats (Harlan Sprague Dawley, Indianapolis, Ind.) were kept under 2% isoflurane anesthesia. Skin was shaven for easy visualization of phenol red dye. 2-2.5 mL of 25 mM MES, pH 5 containing 500 U/ml of rHuPH20 were perfused into the tail skin via a 27-gauge butterfly needle inserted into the dermal layer. This was followed by a solution of 1-1.5 mL of 0.05% phenol red (Sigma-Aldrich, St. Louis, Mo., Cat # P0290) in 10 mM, 25 mM, 50 mM and 100 mM MES buffer, pH 5. MES (2-(N-morpholino-ethanesulfonic acid ($C_{16}H_{13}NO_4A$)) has a molecular weight of 195.2. No rHuPH20 was included in the phenol red solution. Using microcalipers, the phenol red front was measured at different time points, in two dimensions, and the areas were calculated using the formula: Area=$(D1 \times D2) \times \pi/4$. The change in color was observed and time to return to neutrality was recorded. The results of Table 4A summarize the average time in minutes to return to neutrality and indicate that return to neutrality can be modulated by the ionic strength of the buffer.

TABLE 4A

Average time to neutrality

| Buffer strength solution in mM id MES | Initial area of Phenol Red | % reduction after 5 minutes | % reduction after 10 minutes | % reduction after 15 minutes | % reduction after 20 minutes | Average time to neutrality In min |
|---|---|---|---|---|---|---|
| 10; n = 3 | 80 | 71 | 86 | 98 | — | 10 |
| 25; n = 3 | 123 | 59 | 78 | 91 | — | 10 |
| 50; n = 2 | 115 | 38 | 100 | 100 | — | 10 |
| 100; n = 2 | 191 | 15 | 38 | 55 | 71 | 20 |

B. Return to Neutrality Following Acidification of Mouse Skin

The time period to return to neutralization, and subsequent inactivation of cathepsin-L depends on the strength of the injected buffer. The intrinsic buffering capacity of the interstitium was assessed by measuring the time to return to neutralization using a phenol red indicator dye at pH 5.0 with increasing buffer strength (10-100 mM MES) in nude mice. Anesthetized nude mice were injected with 0.125 mL of MES buffer (10 mM to 100 mM), pH 5 containing phenol red. The time to phenol red neutralization in the dermis was measured visually. The results are depicted in Table 4B below.

TABLE 4B

Measurement of Interstitial Buffering Capacity in Mouse Skin

| Buffer | Ionic Strength (mM) | pH | Time to Neutralization (minutes) | SD |
|---|---|---|---|---|
| Phosphate | 10 | 7.4 | 0 | — |
| MES | 10 | 5.0 | 0 | — |
| MES | 25 | 5.0 | 0 | — |
| MES | 50 | 5.0 | 7.3 | 1.25 |
| MES | 100 | 5.0 | 7.8 | 2.1 |

SD: standard deviation

Thus, by intradermal injection of pH indicators in increasing buffer strengths (10-100 mM MES pH 5.0), it was established that an acidic temporal-spatial extracellular environment from 1-20 minutes/100 mm2 injection could be obtained.

EXAMPLE 8

Engineering of Recombinant Human Liver Cathepsin-L

Human Cat-L cDNA SEQ ID NO: 9 (encoded by a sequence of nucleotides set forth in SEQ ID NO:10) and Cat-L-His cDNA SEQ ID NO: 12 (encoded by a sequence of nucleotides set forth in SEQ ID NO:13), were PCR amplified from human liver cDNA (Clonetech QUICK-Clone cDNA 637205) using primers that were designed according to the published sequence data for human kidney procathepsin-L cDNA. 5' NheI and 3' BamHI restriction sites were added as part of the PCR primer synthesis. The primers used in the amplification are set forth in Table 5.

TABLE 5

Primers

| | Primer | Sequence | SEQ ID NO | Tm | length | Match length |
|---|---|---|---|---|---|---|
| Human Cat-L | 5' | 5'-AAGGCCGCTAGCCACCATGGATCC TACACTCATCCTTGCTGC-3' | 16 | 64° C. | 42 mer | 22 |
| | 3' (with two stop codons) | 5'-GAGCACGGATCCTCATCACACAGT GGGGTAGCTGG-3' | 17 | 65° C. | 35 mer | 20 |

TABLE 5-continued

Primers

| Primer | | Sequence | SEQ ID NO | Tm | length | Match length |
|---|---|---|---|---|---|---|
| Cat-L-His | 5' | 5'-AAGGCCGCTAGCCACCATGGATCC TACACTCATCCTTGCTGC-3' | 16 | 64° C. | 42 mer | 22 |
| | 3' (with 6xHis tag) | 5'-CCTGCCGGATCCTCAATGATGATGA TGATGATGCACAGTGGGGTAGCTG-3' | 18 | 57° C. | 49 mer | 16 |

Both cDNA based constructs have the second amino acid of the native Cat-L secretory leader peptide mutated by a single base to form a consensus Kozak sequence, thereby changing the second amino acid from N to D (as set forth in SEQ ID NO: 9 and 12). The identity of the clones was verified by standard agarose gel electrophoresis and DNA sequencing analysis The resulting amplified product was introduced for cloning into the HZ24 (b/s) expression vector. The expression vector is a CMV-based bi-cistronic cassette for expression of both the cathepsin-L protein and the murine DHFR gene separated by an internal ribosomal entry site (IRES) from the encephalomyocarditis virus. The resulting sequence of the HZ24-Cat-L expression vector is set forth in SEQ ID NO:11. The resulting sequence of the HZ24-Cat-L-His expression vector is set forth in SEQ ID NO:14.

Both Cat-L and Cat-L-His expression plasmids were introduced into CHO-S cells (CHO-K1 cells adapted to serum free suspension culture, Invitrogen, Carlsbad, Calif., cat #11619-012) by transfection using Genejuice transfection reagent (EMD Biosciences, San Diego, Calif., cat #70967). The expression plasmids also were introduced into DG44 CHO cells (obtained by license from Dr. Lawrence Chasin, Columbia University), which were adapted to grow in suspension culture in a chemically defined, animal product-free medium (Invitrogen, Cat # 10743-029) by electroporation. For electroporation, greater than 100 µg of ClaI linearized plasmid was used for each electroporation of each of the plasmids. Twenty million DG44 CHO cells per electroporation, at 350 Volts constant voltage were transfected. The electroporation buffer contained 2× HeBS (40 mM HEPES, pH 7.0; 274 mM NaCl; 10 mM KCl; 1.4 mM Na2HPO4; 12 mM dextrose). Transfected cells were cloned by limiting dilution 72 hours after electroporation in standard CD-CHO media (Invitrogen #12610-010) without sodium hypoxanthine and thymidine to select for cells carrying the DHFR plasmid. Selected clones growing without sodium hypoxanthine and thymidine were further subcloned, with amplification using methotrexate to increase insert copy number. A mock transfection served as a negative control.

Supernatants were harvested 72 hours post transfection and spun at 1500 rpm for 5 minutes. Cell free supernatants from CHO-S and CHO-DG44 cells transfected with his-Cat-L, Cat-L and mock were applied to 10 kDa cutoff micron centrifugal concentrators (Millipore; Bedford, Mass. Cat# 42407) and concentrated approximately 10-fold by centrifugation at 12000 rpm at 4° C. Recombinant Human Cathepsin-L secreted into tissue culture supernatants was screened by capture ELISA (Calbiochem Cathepsin-L ELISA Kit #QIA94), Western Blot analysis using the monoclonal Mab 33/1 (Bender MedSystems, Burlingame, Calif.) as described in Example 10 and for enzymatic activity using the fluorescent peptide substrate (Z-L-R-AMC) as described in Example 9.

EXAMPLE 9

Determination of Enzymatic Activity of cathepsin-L using a Fluorogenic Peptide Substrate Enzymatic activity of cathepsin-L was assayed using a commercially available fluorogenic substrate, designated as Z-Leu-Arg-AMC (Z=:N-carbobenzyloxy; AMC: 7-Amino-4-Methyl Coumarin, R&D Systems, Minneapolis, Minn., Cat# ES008). The peptide substrate contains a highly fluorescent 7-amino-4-methyl coumarin group (AMC) that is quenched by the amide bond formed between its amino group and the carboxyl group of the Arg residue. Activated cathepsin-L cleaves this amide bond resulting in an increase in released fluorescence. While the peptide substrate can be cleaved by other cathepsins, prominent among which is cathepsin-B, cathepsin-L activity was specifically determined by using suitable specific inhibitors for the cathepsin-B and measuring activity in the presence and absence of the inhibitor. Specifically the selective cathepsin-B inhibitor CA-074 (Calbiochem, San Diego, Calif., Cat# 205530) was used at a final concentration of 1 µM and samples were assayed in presence and absence of CA-074. Cell culture supernatants from 72 hours post transfection in CHO cells were adjusted to pH 5 by adding concentrated MES buffer at pH 5 and incubated on ice for 30 minutes. This acid activation step cleaves the pro-peptide and generates mature cathepsin-L. To dilute the propeptide fragment which is a potent inhibitor of cathepsin-L enzyme activity (Carmona, E. et al. Potency and selectivity of the cathepsin-L propeptide as an inhibitor of cysteine proteases. Biochemistry 35: 8149-8157 (1996)), the samples were concentrated and buffer exchanged with 50 mM MES pH5 buffer on a 30 KDa microcon tube three times. Samples were then assayed for enzyme activity by the fluorogenic peptide substrate assay on the Z-AMC substrate, A commercial preparation of cathepsin-L (R&D Systems; Cat# 952-CY) was activated in a manner similar to that of the samples, and was used as a standard by serial dilution. Following activation, samples and standards were serially diluted in 100 mM MES buffer pH 5 containing 5 mM DTT and 10 mM EDTA, in an opaque bottom microplate and incubated with the fluorogenic peptide substrate Z-AMC at 37° C. for 30 minutes. Z-AMC substrate was used at a final concentration of 10 µM in a total volume of 200 µL when combined with samples or standards.

The resulting fluorescence was read at the recommended optimum excitation-emission (380 nm-460 nm) band for the substrate in a fluorescent plate reader (Molecular Devices, SpectraMax 3, Sunnyvale, Calif.). Sample values were derived from the standard curve drawn from the relative fluorescence unit (RFU) values obtained from the dilution series of the standard. After a 4-parameter fit with the Softmax® software (Molecular Devices, SpectraMax 3, Sunnyvale, Calif.), the standard curve was pseudo-linear between the concentration ranges of 10-100 ng/mL. The results are shown in Table 6 below. The activity of cathepsin-L from CHO-S transfected cells was at least 10-20 fold higher than background activity from mock transfected host cells and by assaying in presence of the selective cathepsin-B inhibitor CA-074. The increased enzymatic activity in cathepsin-L transfected tissue culture medium can thus be assigned to Cat-L specific activity.

TABLE 6

Cat-L enzyme activity measurements in presence of cathepsin-B inhibitor by Z-AMC assay in transfected cells 72 hours post transfection

| | Clone description | | |
|---|---|---|---|
| | Mock transfected CHO—S | Cat-L transfected CHO—S | His Cat-L transfected CHO—S |
| ng/mL of Cat-L activity | 20 | 723 | 248 |

EXAMPLE 10

Western Blot Analysis of Expressed Human Recombinant Cathepsin-L

Following expression and concentration of cell free supernatants as described in Example 8, Western Blot analysis was performed to confirm expression. Briefly, for each of the 6 different samples (cat-L, cat-L-His and mock from each of CHO-S or CHO-DG44 cells), 30 µL of concentrated supernatants were mixed with 10 µL of 4× (instead of gel loading sample buffer) for SDS-PAGE (EMD Bioscience, San Diego, Calif., cat# 70607-3) and 2 µL of 100 mM DTT and incubated at 80° C. for 20 minutes. As a positive control, 750 ng of commercial purified recombinant cathepsin-L (R&D Systems) in 30 µL of 1×PBS was included and processed identically. The total volume (42 µL) of samples were loaded onto 4-20% Tris-Glycine gels (Invitrogen, Carlsbad, Calif., Cat# EC6028BOX) and electrophoresis was carried out in Tris-Glycine SDS running buffer until the dye front of the prestained molecular weight marker (Invitrogen, Cat# LC5925) reached the bottom of the gel. The proteins were transferred onto PVDF membrane by the I-Blot semi dry blotting apparatus (Invitrogen, Cat# IB1001) according to manufacturer's instructions. Transfer was verified by the almost complete absence of color of the prestained marker bands on the gel. The membrane was blocked in blocker buffer consisting of 5% non fat dry milk in PBS for 2 hours at room temperature. Cathepsin-L was detected with a mouse monoclonal antibody (Mab 33/1) to human cathepsin-L (Bender MedSystems, Burlingame, Calif., Cat# BMS166) used at 1 µg/mL final concentration in blocker and incubated overnight at 4° C. followed by a HRP conjugated goat anti-mouse IgG (Calbiochem, San Diego, Calif., Cat# DC02L) used at a concentration of 33 ng/mL in blocker for 1 hr at room temperature. The HRP signal was developed by the TMB Insoluble (Calbiochem, Cat# 613548) membrane development solution and the reaction was stopped after 30 minutes at room temperature.

Western blot analysis showed protein bands specific for Cat-L. No specific band was detected in the mock transfected cells. The expression level of Cat-L and His-Cat-L appeared to be higher in CHO-S cells than in DG44 cells, probably due to transfection efficiency in the two cell lines. The Western blot analysis results were consistent with results using enzyme activity assay with the fluorogenic peptide substrate Z-AMC as described in Example 9. The molecular weight of cathepsin-L expressed in CHO-S and DG44 is 44-45 KDa which corresponds to the expected size of the protein still containing the propeptide. The molecular weight of commercial cathepsin used as a positive control (R&D Systems) was 36 KDa for mature cathepsin-L. The difference in size between the protein expressed in transfected CHO-S and CHO-DG44 cells and the commercial cathepsin-L may be due to different host cell specific glycosylation or to the removal of the propeptide from the commercial Cat-L.

EXAMPLE 11

A. Generation of Synthetic Cathepsin-L and Cathepsin-L-His

A DNA construct encoding human cathepsin-L, (amino acids 18-333 of GenBank Accession No. EAW62736; SEQ ID NO:62) was synthesized using codon optimization for CHO cells. Codon optimization was based on codon optimization table for Cricetulus griseus, listed by Blue Heron Biotech (blueheronbio.com). The construct was synthesized to contain a heterologous signal peptide designed from the human kappa IgG gene family (SEQ ID NO:2) to permit secretion of the recombinant protein into tissue culture supernatant. The nucleotide sequence of the optimized cathepsin-L construct is set forth in SEQ ID NO: 3 and encodes a polypeptide set forth in SEQ ID NO:4. A 5' Nhe I restriction site and a 3' BamH I restriction site were incorporated as part of the construct synthesis. The synthetic construct was then introduced into the HZ24 (b/s) expression vector, as described in Example 8. The synthetic Cat-L expression vector was designated HZ24 (B/S)-CAT-L and is set forth in SEQ ID NO:5. Another Cat-L construct containing a C-terminal 6 Histidine tag separated by a linker (GGGGSG; SEQ ID NO:15) also was synthesized. The nucleotide sequence of the synthesized Cat-L-His construct is set forth in SEQ ID NO:6 and encodes a polypeptide set forth in SEQ ID NO:7. This construct also contained a 5' Nhe I and a 3' BamH I restriction site, incorporated as part of the construct synthesis, and was introduced into the HZ24 (b/s) expression vector. The synthetic Cat-L-His expression vector was designated HZ24 (B/S)-CAT-L-His and is set forth in SEQ ID NO: 8.

The synthetic Cat-L expression vector set forth in SEQ ID NO:5 and the synthetic Cat-L-His expression vector set forth in SEQ ID NO:8 were transfected into CHO-DG44 cells by electroporation, as described in Example 8. Supernatants were harvested for 72 hours post-transfection and were processed as described in Example 8 (without pH adjustment) to generate non-activated cathepsin-L.

Tissue culture supernatants also were processed to result in the activation of cathepsin-L. This was achieved using a low pH, resulting in cleavage of the pro-peptide of cathepsin-L, resulting in the activation of the enzyme. Supernatants from cells transfected with the synthetic construct and un-transfected control cells were adjusted to pH 4 by adding concentrated acidic buffer (1000 mM Formate pH 4, 1000 mM NaCl, 50 mM DTT, 100 mM EDTA) to the supernatants in a ratio of 1:10, respectively. The supernatants were incubated on ice for 30 minutes to allow for complete activation. They were then concentrated by centrifuging through a 30 KDa molecular weight cutoff centrifugal concentration device (Microcon 30, Millipore, Bedford, Mass. Cat# 42410), which allowed the cleaved propeptide (with a predicted size of approximately 12-14 KDa) to pass through, while retaining the mature protein (predicted size about 36-40 kDa). Following concentration, activated and non-activated supernatants were run on a 4-12% SDS-PAGE gel followed by analysis by Western Blot using the monoclonal Mab 33/1 as described in Example 10. Synthetic Cathepsin-L and Cat-L-His were detected in tissue culture supernatants of transfected cells at similar levels. The molecule weight of the Cathepsin-L and Cat-L-His in non-activated supernatants was about 44 kDa, compared to about 36 to 40 kDa for the activated supernatants, due to the absence of the pro-peptide.

Activated supernatants also were screened for Cathepsin-L enzymatic activity using the fluorescent peptide substrate (Z-L-R-AMC) as described in Example 9. Cat-L enzyme activity was measured in the presence of the cathepsin-B inhibitor (to block host cathepsin-B-like enzyme activity) by Z-AMC assay in transfected CHO-DG44 cells 72 hours post transfection. The results are set forth in Table 7 below. The activity of cathepsin-L from CHO-DG44 transfected cells 72 hours post transfection was about 6-17 fold higher than background activity from mock transfected host cells. By assaying in the presence of the selective cathepsin-B inhibitor CA-074, the contribution from host cathepsin-B like enzyme activity was blocked. Thus, the increased enzymatic activity in cathepsin-L transfected tissue culture medium can be assigned to Cat-L specific activity expressed from the transfected Cat-L clones.

TABLE 7

| | Clone description | | |
|---|---|---|---|
| | Mock transfected | Cat-L transfected | His Cat-L transfected |
| ng/mL of Cat-L activity | Less than 100 | 1700 | 600 |

B. Selection of Synthetic Cathepsin-L Clones in Methotrexate

The synthetic Cathepsin-L cells, produced as described in section A, above, were cloned by limiting dilution after electroporation in standard CD-CHO media without sodium hypoxanthine and thymidine to select for cells carrying a plasmid with the DHFR gene, then further sub-cloned and expanded in the presence of 50 mM methotrexate to increase insert copy number. Subsequent rounds of sub-cloning and expansion in 200 mM and 1000 mM were then performed to identify methotrexate-amplified cells lines suitable for use in large scale production of cathepsin L.

1. Cloning and Identification of Cat-L Cell Clones in No Methotrexate

To select cells and identify Cat-L cell clones that grew in the absence of methotrexate, cells from the transfection described above were collected and washed twice with standard CD-CHO media (GIBCO; Invitrogen) containing 4 mM GlutaMAX™-I (GIBCO; Invitrogen), and without hypoxanthine and thymidine supplements, by brief centrifugation at 500×g. After the final wash, cell were counted, and diluted to 10,000 to 20,000 viable cells per mL. A 0.1 mL aliquot of the cell suspension was transferred to each well of ten, 96 well round bottom tissue culture plates. All plates were supplemented with an additional 0.1 mL of the same. Cells were allowed to grow at 37° C., 5% $CO_2$ in a humidified incubator.

Wells containing growing colonies of cells under selection without hypoxanthine and thymidine were identified by a combination of Cathepsin-L enzyme assay and visual appearance of cell growth in culture wells. Enzyme activity in the tissue culture supernatant of each well was assessed as described in Example 9. Twenty clones were identified (Table 7a).

TABLE 7a

| Clone (Plate/well) ID | Relative Cat-L activity (rfu) |
|---|---|
| 1C5 | 8957 |
| 1F6 | 9161 |
| 2F2 | 8722 |
| 2C8 | 8487 |
| 3E4 | 4952 |
| 3F8 | 8599 |
| 4F4 | 9540 |
| 4D10 | 3374 |
| 5B2 | 10065 |
| 5B10 | 11709 |
| 6E3 | 9393 |
| 6G11 | 5214 |
| 7B2 | 6792 |
| 7G9 | 9619 |
| 8E4 | 3124 |
| 8D7 | 3085 |
| 9A5 | 6226 |
| 9E12 | 7653 |
| 10D3 | 2053 |
| 10F6 | 3895 |

The identified clones were expanded into individual wells of 24-well tissue culture plates, containing 1 mL of CD-CHO media supplemented with 4 mM GlutaMAX™-I, and without hypoxanthine and thymidine. The cells were grown at 37° C., 5% $CO_2$ in a humidified incubator. The cells were further expanded into T-75 tissue culture flasks in the same media. Three vials of each clone were archived by freezing in 10% DMSO, 45% conditioned media.

2. Cloning and Identification of Cells in 50 nM Methotrexate

The 20 cell line sub-clones demonstrating proliferation and expression of Cat-L enzymatic activity were sub-cloned from 24 well plates into 96-well round bottom tissue culture plates, using a two-dimensional infinite dilution strategy, in which the cells are diluted 1 in 3 across the plate, and 1 in 2 down the plate. Diluted sub-clones were grown in a background of 500 non-transfected DG44 CHO cells per well, to provide necessary growth factors for the initial days in culture. Five plates were made per sub-clone, containing a final concentration of 50 nM methotrexate in CD-CHO media supplemented with 4 mM GlutaMAX™-I, and without hypoxanthine and thymidine. Cells were grown at 37° C., 5% $CO_2$ in a humidified incubator.

The sub-clones growing in 50 nM methotrexate that expressed recombinant human (synthetic) Cat-L were identified by measuring Cat-L enzyme activity as described in Example 9. Wells demonstrating substantially higher enzymatic activity were compared to the neighboring wells microscopically, and high expressing outlier clones were chosen for expansion. A total of 96 individual clones were expanded into 12-well tissue culture plates containing a final concentration of 50 nM methotrexate in CD-CHO media supplemented with 4 mM GlutaMAX™-I, and without hypoxanthine and thymidine. The cells were grown at 37-C, 5% $CO_2$ in a humidified incubator.

These 96 sub-clones were tested for secreted Cat-L enzymatic activity as described in Example 9 at two different times points, 7 days apart. The sub-clones demonstrating the greatest increases in Cat-L enzymatic activity over the 7 day period and healthy microscopic appearance were chosen for propagation. The 7 sub-clones that were propagated included 9E12 (#16), 7G9 (#50), 1C5 (#69), 4F4 (#76), 1F6 (#77), 5B10 (#90) and 2F2 (#92). These sub-clones were expanded in the presence of 50 nM methotrexate into T-25 and T-75 flasks and archived by freezing.

3. Cloning and Identification of Cells in 200 nM Methotrexate

Sub-clones 9E12 (#16), 7G9 (#50), 1C5 (#69), 4F4 (#76), 1F6 (#77), 5B10 (#90) and 2F2 (#92) were then sub-cloned into media containing 200 nM methotrexate. Five, 96-well round bottom tissue culture plates were set-up using the two-dimensional infinite dilution strategy for each of the seven sub-clones. Diluted sub-clones were grown in a background of 500 non-transfected DG44 CHO cells per well in CD-CHO media supplemented with 200 nM methotrexate and 4 mM GlutaMAX™-I (without hypoxanthine and thymidine). The 35 plates were incubated at 37° C., 5% $CO_2$ in a humidified incubator.

The sub-clones expressing high levels of rHuCat-L while being grown in 200 nM methotrexate were identified by measuring Cat-L enzyme activity in the cell culture supernatant, as described in Example 9. A total of 35 sub-clones (5 from each of 9E12 (#16), 7G9 (#50), 1C5 (#69), 4F4 (#76), 1F6 (#77), 5B10 (#90) and 2F2 (#92) were selected and expanded into 24-well tissue culture plates in CD-CHO media supplemented with 200 nM methotrexate and 4 mM GlutaMAX™-I (without hypoxanthine and thymidine). The sub-clones were incubated at 37° C., 5% $CO_2$ in a humidified incubator.

The 35 sub-clones were assayed for Cat-L activity, and the 10 sub-clones expressing the highest levels of secreted enzymatic activity were propagated to 6-well tissue culture plates. The 10 clones, and the clones from which they were derived in Table 7b. These 10 sub-clones were subsequently expanded into T75 tissue culture flasks and then into shaker flasks in CD-CHO media supplemented with 200 nM methotrexate and 4 mM GlutaMAX™-I (without hypoxanthine and thymidine). Shaker flasks growing the subclones were expanded, and cells archived by freezing.

Four sub-clones, 9E12-3D3 and 7G9-2F2, 7G9-3F1 and 7G9-5F2, demonstrating early rapid cell expansion (shorter doubling times) in small shaker flasks for greater than 7 passages were expanded for inoculation of 4×10 L controlled Bioreactors for comparative expression and production studies. The four sub-clones also were continuously expanded and passaged in 1 L shaker flasks containing CD-CHO media supplemented with 200 nM methotrexate and 4 mM GlutaMAX™-I. Cell density and viability were measured every other day, with cell-free retains stored at 4C for later evaluation of enzyme activity.

TABLE 7b

| Primary Clone | 50 nM methotrexate sub-clones | 200 nM methotrexate sub-clones |
|---|---|---|
| 1C5 | 1C5-3 | 3-2F2 |
| 1C5 | 1C5-3 | 3-1F2 |
| 2F2 | 2F2-7 | 7-5F3 |

TABLE 7b-continued

| Primary Clone | 50 nM methotrexate sub-clones | 200 nM methotrexate sub-clones |
|---|---|---|
| 4F4 | 4F4-4 | 4-3C3 |
| 4F4 | 4F4-4 | 4-4B3 |
| 7G9 | 7G9-2 | 2-2F2 |
| 7G9 | 7G9-2 | 2-3F1 |
| 7G9 | 7G9-2 | 2-5F2 |
| 9E12 | 9E12-1 | 1-3D3 |
| 9E12 | 9E12-1 | 1-1C2 |

4. Cloning and Identification of Cells in 1000 nM Methotrexate

The 9E12-1-3D3 and 1C5-3-2F2 were sub-cloned for a third time into 1000 nM methotrexate containing media on Jul. 1, 2008. Five, 96-well round bottom tissue culture plates were set-up using the two-dimensional infinite dilution strategy for each of the two sub-clones. The diluted sub-clones were grown in a background of 500 non-transfected DG44 CHO cells per well at 37° C., 5% $CO_2$ in a humidified incubator, CD-CHO media containing 1000 nM methotrexate and 4 mM GlutaMAX™-I (without hypoxanthine and thymidine).

Wells containing sub-clones growing in 1000 nM methotrexate were identified by visual and microscopic examination. Twenty wells containing growing cells diluted from the 9E12-1-3D3 and 1C5-3-2F2 sub-clones (10 wells per sub-clone) were then assayed for rHuCat-L expression by Western Blot. All 20 sub-clones were expanded to 12-well tissue culture plates in CD-CHO media containing 1000 nM methotrexate and 4 mM GlutaMAX™-I (without hypoxanthine and thymidine) and incubated at 37° C., 5% $CO_2$ in a humidified incubator. Table 7c sets forth the 20 sub-clones, and the sub-clones from which they were derived. The clones able to grow in 1000 nM methotrexate are then expanded and assayed for Cat-L enzymatic activity, and archived by freezing in liquid nitrogen.

TABLE 7c

| Primary Clone | 50 nM methotrexate sub-clones | 200 nM methotrexate sub-clones | 1000 nM methotrexate sub-clones |
|---|---|---|---|
| 9E12 | 9E12-1 | 1-3D3 | 1F5 |
| 9E12 | 9E12-1 | 1-3D3 | 1E2 |
| 9E12 | 9E12-1 | 1-3D3 | 2D4 |
| 9E12 | 9E12-1 | 1-3D3 | 2G8 |
| 9E12 | 9E12-1 | 1-3D3 | 3E3 |
| 9E12 | 9E12-1 | 1-3D3 | 3G2 |
| 9E12 | 9E12-1 | 1-3D3 | 4D4 |
| 9E12 | 9E12-1 | 1-3D3 | 4F3 |
| 9E12 | 9E12-1 | 1-3D3 | 5D2 |
| 9E12 | 9E12-1 | 1-3D3 | 5F2 |
| 1C5 | 1C5-3 | 3-2F5 | 1D4 |
| 1C5 | 1C5-3 | 3-2F5 | 1G2 |
| 1C5 | 1C5-3 | 3-2F5 | 2E2 |
| 1C5 | 1C5-3 | 3-2F5 | 2E3 |
| 1C5 | 1C5-3 | 3-2F5 | 3D6 |
| 1C5 | 1C5-3 | 3-2F5 | 3G3 |
| 1C5 | 1C5-3 | 3-2F5 | 4E4 |
| 1C5 | 1C5-3 | 3-2F5 | 4G2 |
| 1C5 | 1C5-3 | 3-2F5 | 5F4 |
| 1C5 | 1C5-3 | 3-2F5 | 5G5 |

B. Large Scale Production and Purification of Cathepsin L

To purify the synthetic Cathepsin-L in large quantities, unactivated pro-Cathepsin L cell culture supernatant from the cell line 9E12-1-3D3, produced as described above, was cultured in a 36 L bioreactor. Following incubation in the bioreactor, the cell culture was clarified by harvest filters, concentrated and buffer-exchanged using tangential flow filtration, viral-inactivated by solvent/detergent, and then purified by sequential chromatography on Q Sepharose Fast Flow (GE Healthcare) anion exchange chromatography and Ceramic Hydroxyapatite chromatography (Biorad, Richmond, Calif.). Following treatment at reduced pH (pH 4.5), activated Cathepsin-L was further purified by SP Sepharose Fast Flow (GE Healthcare) cation exchange chromatography, viral filtration and tangential flow filtration.

The 9E12-1-3D3 cell line was first expanded through a series of flasks. Briefly, 35 mL of culture at passage 6, with $6 \times 10^5$ cell/mL and a viability of 73% was expanded to 200 mL with CD CHO media (Invitrogen) supplemented with 40 mL/L GlutaMAX™-I (Invitrogen; stock solution 200 mM) and 200 nM methotrexate. At four days, it was expanded to 1200 mL in a 6 L sparged spinner using CD CHO media supplemented with 40 mL/L GlutaMAX™-I. In the 6 L spinner, the culture was then expanded to 2200 mL on day 11, to 3500 mL on day 15, and finally to 5000 mL on day 18, each time using CD CHO media supplemented with 40 mL/L GlutaMAX™-I.

The 36 L bioreactor, containing 20 L CD CHO medium supplemented with 800 mL GlutaMAX™-1,100 mg of recombinant human insulin (rHuInsulin), and 30 mL Gentamicin, was inoculated with an initial seeding density of $4.6 \times 10^5$ cells/mL. To provide smooth mixing and a slight vortex in the culture, the agitation set point was 80 RPM, the temperature setpoint was 37° C., the pH setpoint was pH 7.15, and the dissolved oxygen setpoint was 25%. The bioreactor vessel received filtered air overlay and an air/oxygen/$CO_2$ sparge, as controlled by an Applikon ADI 1030 controller. A constant air sparge of 0.1-0.2 slpm was provided, with the $O_2$ solenoid valve as a slave to the DO controller, such that the $O_2$ flow automatically supplemented the constant air sparge as needed.

During the bioreactor run, the culture was supplemented with feed media at various intervals to supplement nutrients and glucose throughout the bioreactor run, as well as providing additional basal medium concentrate and GlutaMAX™-I in the early, growth phase of the cells, in order to maximize the growth rate and peak cell density. Additional protein digest (Yeastolate Utlrafiltrate 50× (200 g/L); Invitrogen) and sodium butyrate were added in the late, production phase of the bioreactor run maximize expression and secretion of product. The feed media was sterile filtered into the bioreactor via peristaltic pump. On days 7, 10, 12, 13, 14 and 16, 500 mL of Feed #1-6, respectively, were added to the bioreactor cell cure. Feed #1 and Feed #2 contained 48.6 g/L powdered CD CHO AG™ media, 200 mL/L GlutaMAX™-I (final concentration 8 mM), 200 mL/L Yeastolate Utlrafiltrate 50× (final concentration 8 g/L), 50 g D-Glucose (Dextrose; Invitrogen), and 1.1 g sodium butyrate. Feed #3 through Feed #6 contained 48.6 g/L powdered CD CHO AG™ media, 100 mL/L GlutaMAX™-I (final concentration 4 mM), 300 mL/L Yeastolate Utlrafiltrate 50× (final concentration 12 g/L), 40 g D-Glucose (Dextrose; Invitrogen), and 1.6 g sodium butyrate. The cell culture was sampled before each feeding and prior to harvest (day 19) to test for viable cell density (VCD) and % viability by hemocytometer with Trypan Blue staining, and residual glucose. Table 8 sets forth the results of the testing.

TABLE 7d

| Hours post inoculation | VCD × $10^5$ cells/mL | % viability | Cell culture volume (L) | Glucose | Feed |
|---|---|---|---|---|---|
| 0 | 4.6 | 87 | 26 | 8280 | |
| 72 | 16.3 | 93 | 26 | 4690 | |
| 115 | 37.6 | 93 | 26 | 4230 | |
| 165 | 43.1 | 83 | 26 | 1830 | Feed #1 |
| 234 | 45.7 | 78 | 26.5 | 1040 | Feed #2 |
| 264 | 49.7 | 78 | 27 | 1320 | |
| 287 | 42.2 | 78 | 27 | 800 | Feed #3 |
| 312 | 39.8 | 74 | 27.5 | 1180 | Feed #4 |
| 336 | 39.1 | 73 | 27.5 | 1390 | Feed #5 |
| 386 | 28.3 | 58 | 28 | 1360 | Feed #6 |
| 409 | 24.5 | 50 | 28.5 | 1810 | |
| 432 | 20.5 | 36 | 28.5 | 1530 | |
| 448 | 18.9 | 31 | 28.5 | 1190 | Harvest |

The bioreactor was harvested on day 19, and the cell culture (approximately 28.5 L) was clarified by filtration to remove cells and cell debris. The cell removal and clarification filtration consisted of Millipore Pod filters DOHC (0.5 m$^2$) and A1HC (0.1 m$^2$). The Millipore Pods were first flushed with water for injection (WFI) followed by equilibration with PBS, before the harvest was added. Following clarification, the harvested cell culture fluid (HCCF) was filtered into storage bags via small capsule filters (Sartobran 300, 0.45 μm, Sartorius). The HCCF (31.6 L, consisting of 28.5 L of culture supernatant and 3.1 L of PBS flush volume) was supplemented to yield 50 mM Tris and stored at 2-8° C.

The HCCF was then concentrated and diafiltered by tangential flow filtration (TFF), consisting of 5×1 ft$^2$ of PES membrane with a 30 kDa molecular weight cut-off. The membrane was first equilibrated in 20 mM Bis-Tris, 50 mM NaCl, pH 7.0. The 31.6 L HCCF was added to the TFF system concentrated 10× to 3 L, then dialfiltered with 28 L of 20 mM Bis-Tris, 50 mM NaCl, pH 7.0. The concentrated HCCF was filtered through a 0.2 μm filter, yielding a final volume of 3 L. Viral inactivation was effected by treating the concentrated/buffer exchanged harvest with 1% Triton X-100 and 0.3% tri-n-butyl phosphate for 90 minutes at room temperature.

A Q Sepharose Fast Flow (GE Healthcare) anion exchange column was prepared. Post sanitization, charging, and neutralization, the column was equilibrated with five column volumes of 20 mM Bis-Tris, pH 7.0. Following viral inactivation, the concentrated, buffer exchanged harvest was loaded onto the Q column using a five minute residence time for all steps (407 cm/hr). The column was sequentially washed with five column volumes of 20 mM Bis-Tris, pH 7.0 and five column volumes of 20 mM Bis-Tris, 50 mM NaCl, pH 7.0. The protein was eluted with 20 mM Bis-Tris, 160 mM NaCl, pH 7.0.

A ceramic hydroxyapatite (CHT) column (BioRad) was equilibrated with 5 mM sodium phosphate, pH 7.0 post sanitization, charging, and neutralization. The Q Sepharose purified protein was loaded onto the CHT column using a five minute residence time for all steps (257 cm/hr). The column was sequentially washed with five column volumes of 5 mM sodium phosphate, pH 7.0 and five column volumes 10 mM sodium phosphate, pH 7.0. The protein was eluted with 70 mM sodium phosphate, pH 7.0.

Pro-cathepsin L was then activated to Cathepsin L by adjusting the pH to 4.5 with 0.5 M sodium acetate, pH 4.0. Following activation, the Cathepsin L was further purified by SP Sepharose Fast Flow chromatography. A SP Sepharose Fast Flow (GE Healthcare) ion exchange column was prepared and equilibrated with five column volumes of 50 mM sodium acetate, pH 4.5 post sanitization, charging, and neutralization. Prior to loading, the activated Cathepsin L was diluted two-fold with 50 mM sodium acetate, pH 4.5. The activated Cathepsin L was loaded onto the SPFF column using a five minute residence time for all steps (253 cm/hr). The column was washed with five column volumes of 50 mM sodium acetate, pH 4.5. The protein was eluted with 50 mM sodium acetate, 50 mM NaCl, pH 5.0. The purified protein is then filtered to remove viruses, and concentrated, such as to between 1-20 mg/mL.

EXAMPLE 12

Generation of a Soluble Recombinant Human pH20 (rHuPH20) Expressing Cell Line

The HZ24 plasmid (set forth in SEQ ID NO:224) was used to transfect Chinese Hamster Ovary (CHO cells). The DNA encoding the soluble rHuPH20 construct contains an NheI site and a Kozak consensus sequence prior to the DNA encoding the methionine at amino acid position 1 of the native signal leader of human PH20 hyaluronidase, and a stop codon following the DNA encoding the tyrosine at amino acid position 482 of human PH20 hyaluronidase, followed by a BamHI restriction site. The construct pCI-PH20-IRES-DHFR-SV40pa (HZ-24), therefore, results in a single mRNA species driven by the CMV promoter that encodes amino acids 1-482 of PH20 (set forth in SEQ ID NO:225) and amino acids 1-187 of the dihydrofolate reductase (set forth in SEQ ID NO:261), separated by an internal ribosomal entry site (IRES).

Non-transfected DG44 CHO cells were grown in GIBCO Modified CD-CHO media for DHFR(−) cells, supplemented with 4 mM Glutamax™ and 18 ml Plurionic F68/L (Gibco), and were seeded at $0.5\times10^6$ cells/ml in a shaker flask in preparation for transfection. Cells were grown at 37° C. in 5% $CO_2$ in a humidified incubator, shaking at 120 rpm. Exponentially growing non-transfected DG44 CHO cells were tested for viability prior to transfection.

Sixty million viable cells of the non-transfected DG44 CHO cell culture were pelleted and resuspended to a density of $2\times10^7$ cells in 0.7 mL of 2× transfection buffer (2× HeBS: 40mM Hepes, pH 7.0, 274 mM NaCl, 10 mM KCl, 1.4 mM $Na_2HPO_4$, 12 mM dextrose). To each aliquot of resuspended cells, 0.09 mL (250 µg) of the linear HZ24 plasmid (linearized by overnight digestion with Cla I (New England Biolabs); linear HZ24 plasmid set forth in SEQ ID NO: 224) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 µF or at 350 V and 960 µF.

The cells were removed from the cuvettes after electroporation and transferred into 5 mL of Modified CD-CHO media for DHFR(−) cells, supplemented with 4 mM Glutamine and 18 ml Plurionic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity (see Example 16). The results are set forth in Table 8 below.

TABLE 8

Initial Hyaluronidase Activity of HZ24 Transfected DG44 CHO cells at 40 hours post-transfection

|  | Dilution | Activity Units/ml |
|---|---|---|
| Transfection 1 330 V | 1 to 10 | 0.25 |
| Transfection 2 350 V | 1 to 10 | 0.52 |
| Negative Control | 1 to 10 | 0.015 |

Cells from Transfection 2 (350V) were collected from the tissue culture well, counted and diluted to $1\times10^4$ to $2\times10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate (see Table 9).

TABLE 9

| Plate/ Well ID | Relative Hyaluronidase |
|---|---|
| 1C3 | 261 |
| 2C2 | 261 |
| 3D3 | 261 |
| 3E5 | 243 |
| 3C6 | 174 |
| 2G8 | 103 |
| 1B9 | 304 |
| 2D9 | 273 |
| 4D10 | 302 |

Six HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment.) Significant hyaluronidase activity was measured in the supernatants from 8 of the 24 subclones (>50 Units/mL), and these 8 subclones were expanded into T-25 tissue culture flasks in the presence of 50 nM methotrexate where appropriate. Clone 3D3 50 nM was further expanded in 500 nM methotrexate giving rise to clones producing in excess of 1,000 Units/ml in shaker flasks (clone 3D35M; generation 1 or Gen1 3D35M).

EXAMPLE 13

Production and Purification of Gen1 Human sPH20

A. 5 L Bioreactor Process

A vial of 3D35M was thawed and expanded from shaker flasks through 1 L spinner flasks in CD-CHO media (Invitrogen, Carlsbad Calif.) supplemented with 100 nM Methotrexate and GlutaMAX™-1 (Invitrogen). Cells were transferred from spinner flasks to a 5 L bioreactor (Braun) at an inoculation density of 4×10$^5$ viable cells per ml. Parameters were temperature Setpoint 37° C., pH 7.2 (starting Setpoint), with Dissolved Oxygen Setpoint 25% and an air overlay of 0-100 cc/min. At 168 hrs, 250 ml of Feed #1 Medium (CD CHO with 50 g/L Glucose) was added. At 216 hours, 250 ml of Feed #2 Medium (CD CHO with 50 g/L Glucose and 10 mM Sodium Butyrate) was added, and at 264 hours 250 ml of Feed #2 Medium was added. This process resulted in a final productivity of 1600 Units per ml with a maximal cell density of 6×10$^6$ cells/ml. The addition of sodium butyrate was to dramatically enhance the production of soluble rHuPH20 in the final stages of production.

Conditioned media from the 3D35M clone was clarified by depth filtration and tangential flow diafiltration into 10 mM Hepes pH 7.0. Soluble rHuPH20 was then purified by sequential chromatography on Q Sepharose (Pharmacia) ion exchange, Phenyl Sepharose (Pharmacia) hydrophobic interaction chromatography, phenyl boronate (Prometics) and Hydroxapatite Chromatography (Biorad, Richmond, Calif.).

Soluble rHuPH20 bound to Q Sepharose and eluted at 400 mM NaCl in the same buffer. The eluate was diluted with 2M ammonium sulfate to a final concentration of 500 mM ammonium sulfate and passed through a Phenyl Sepharose (low sub) column, followed by binding under the same conditions to a phenyl boronate resin. The soluble rHuPH20 was eluted from the phenyl sepharose resin in Hepes pH 6.9 after washing at pH 9.0 in 50 mM bicine without ammonium sulfate. The eluate was loaded onto a ceramic hydroxyapatite resin at pH 6.9 in 5 mM potassium phosphate and 1 mM CaCl$_2$ and eluted with 80 mM potassium phosphate, pH 7.4 with 0.1 mM CaCl$_2$.

The resultant purified soluble rHuPH20 possessed a specific activity in excess of 65,000 USP Units/mg protein by way of the microturbidity assay (Example 16) using the USP reference standard. Purified sPH20 eluted as a single peak from 24 to 26 minutes from a Pharmacia 5RPC styrene divinylbenzene column with a gradient between 0.1% TFA/H$_2$O and 0.1% TFA/90% acetonitrile/10% H$_2$O and resolved as a single broad 61 kDa band by SDS electrophoresis that reduced to a sharp 51 kDa band upon treatment with PNGASE-F. N-terminal amino acid sequencing revealed that the leader peptide had been efficiently removed.

B. Upstream Cell Culture Expansion Process into 100 L Bioreactor Cell Culture

A scaled-up process was used to separately purify soluble rHuPH20 from four different vials of 3D35M cell to produce 4 separate batches of sHuPH20; HUA0406C, HUA0410C, HUA0415C and HUA0420C. Each vial was separately expanded and cultured through a 125 L bioreactor, then purified using column chromatography. Samples were taken throughout the process to assess such parameters as enzyme yield. The description of the process provided below sets forth representative specifications for such things as bioreactor starting and feed media volumes, transfer cell densities, and wash and elution volumes. The exact numbers vary slightly with each batch, and are detailed in Tables 3 to 10.

Four vials of 3D35M cells were thawed in a 37° C. water bath, CD CHO containing 100 nM methotrexate and 40 mL/L GlutaMAX was added and the cells were centrifuged. The cells were re-suspended in a 125 mL shake flask with 20 mL of fresh media and placed in a 37° C., 7% CO$_2$ incubator. The cells were expanded up to 40 mL in the 125 mL shake flask. When the cell density reached 1.5-2.5×10$^6$ cells/mL, the culture was expanded into a 125 mL spinner flask in a 100 mL culture volume. The flask was incubated at 37° C., 7% CO$_2$. When the cell density reached 1.5-2.5×10$^6$ cells/mL, the culture was expanded into a 250 mL spinner flask in 200 mL culture volume, and the flask was incubated at 37° C., 7% CO$_2$. When the cell density reached 1.5-2.5×10$^6$ cells/mL, the culture was expanded into a 1 L spinner flask in 800 mL culture volume and incubated at 37° C., 7% CO$_2$. When the cell density reached 1.5-2.5×10$^6$ cells/mL, the culture was expanded into a 6 L spinner flask in 5 L culture volume and incubated at 37° C., 7% CO$_2$. When the cell density reached 1.5-2.5×10$^6$ cells/mL, the culture was expanded into a 36 L spinner flask in 20 L culture volume and incubated at 37° C., 7% CO$_2$.

A 125 L reactor was sterilized with steam at 121° C., 20 PSI and 65 L of CD CHO media was added. Before use, the reactor was checked for contamination. When the cell density in the 36 L spinner flasks reached 1.8-2.5×10$^6$ cells/mL, 20 L cell culture were transferred from the 36 L spinner flasks to the 125 L bioreactor (Braun), resulting a final volume of 85 L and a seeding density of approximately 4×10$^5$ cells/mL. Parameters were temperature setpoint, 37° C.; pH: 7.2; Dissolved oxygen: 25%±10%; Impeller Speed 50 rpm; Vessel Pressure 3 psi; Air Sparge 1 L/min.; Air Overlay: 1 L/min. The reactor was sampled daily for cell counts, pH verification, media analysis, protein production and retention. Nutrient feeds were added during the run. At Day 6, 3.4 L of Feed #1 Medium (CD CHO+50 g/L Glucose+40 mL/L GlutaMAX™-1) was added, and culture temperature was changed to 36.5° C. At day 9, 3.5 L of Feed #2 (CD CHO+50 g/L Glucose+40 mL/L GlutaMAX™-1+1.1 g/L Sodium Butyrate) was added, and culture temperature was changed to 36° C. At day 11, 3.7 L of Feed #3 (CD CHO+50 g/L Glucose+40 mL/L GlutaMAX™-1+1.1 g/L Sodium Butyrate) was added, and the culture temperature was changed to 35.5° C. The reactor was harvested at 14 days or when the viability of the cells dropped below 50%. The process resulted in production of soluble rHuPH20 with an enzymatic activity of 1600 Units/ml with a maximal cell density of 8 million cells/mL. At harvest, the culture was sampled for mycoplasma, bioburden, endotoxin, and virus in vitro and in vivo, transmission electron microscopy (TEM) for viral particles, and enzyme activity.

The one hundred liter bioreactor cell culture harvest was filtered through a series of disposable capsule filters having a polyethersulfone medium (Sartorius): first through a 8.0 μm depth capsule, a 0.65 μm depth capsule, a 0.22 μm capsule, and finally through a 0.22 μm Sartopore 2000 cm$^2$ filter and into a 100 L sterile storage bag. The culture was concentrated 10× using two TFF with Spiral Polyethersulfone 30 kDa MWCO filters (Millipore), followed by a 6× buffer exchange with 10 mM HEPES, 25 mM Na$_2$SO$_4$, pH 7.0 into a 0.22 μm final filter into a 20 L sterile storage bag. Table 10 provides monitoring data related to the cell culture, harvest, concentration and buffer exchange steps.

TABLE 10

Monitoring data for cell culture, harvest, concentration and buffer exchange steps.

| Parameter | HUA0406C | HUA04010C | HUA0415C | HUA0420C |
|---|---|---|---|---|
| Time from thaw to inoculate 100 L bioreactor (days) | 21 | 19 | 17 | 18 |

TABLE 10-continued

Monitoring data for cell culture, harvest, concentration and buffer exchange steps.

| Parameter | HUA0406C | HUA04010C | HUA0415C | HUA0420C |
|---|---|---|---|---|
| 100 L inoculation density ($\times 10^6$ cells/mL) | 0.45 | 0.33 | 0.44 | 0.46 |
| Doubling time in logarithmic growth (hr) | 29.8 | 27.3 | 29.2 | 23.5 |
| Max. cell density ($\times 10^6$ cells/mL) | 5.65 | 8.70 | 6.07 | 9.70 |
| Harvest viability (%) | 41 | 48 | 41 | 41 |
| Harvest titer (U/ml) | 1964 | 1670 | 991 | 1319 |
| Time in 100-L bioreactor (days) | 13 | 13 | 12 | 13 |
| Clarified harvest volume (mL) | 81800 | 93300 | 91800 | 89100 |
| Clarified harvest enzyme assay (U/mL) | 2385 | 1768 | 1039 | 1425 |
| Concentrate enzyme assay (U/mL) | 22954 | 17091 | 8561 | 17785 |
| Buffer exchanged concentrate enzyme assay (U/mL) | 15829 | 11649 | 9915 | 8679 |
| Filtered buffer exchanged concentrate enzyme assay (U/mL) | 21550 | 10882 | 9471 | 8527 |
| Buffer exchanged concentrate volume (mL) | 10699 | 13578 | 12727 | 20500 |
| Ratio enzyme units concentration/harvest | 0.87 | 0.96 | 1.32 | 1.4 |

A Q Sepharose (Pharmacia) ion exchange column (3 L resin, Height=20 cm, Diameter=14 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. The concentrated, diafiltered harvest was loaded onto the Q column at a flow rate of 100 cm/hr. The column was washed with 5 column volumes of 10 mM Tris, 20 mM $Na_2SO_4$, pH 7.5 and 10 mM Hepes, 50 mM NaCl, pH 7.0. The protein was eluted with 10 mM Hepes, 400 mM NaCl, pH 7.0 and filtered through a 0.22 μm final filter into a sterile bag.

Phenyl-Sepharose (Pharmacia) hydrophobic interaction chromatography was next performed. A Phenyl-Sepharose (PS) column (9.1 L resin, Height=29 cm, Diameter=20 cm) was prepared. The column was equilibrated with 5 column volumes of 5 mM potassium phosphate, 0.5 M ammonium sulfate, 0.1 mM $CaCl_2$, pH 7.0. The protein eluate from above was supplemented with 2M ammonium sulfate, 1 M potassium phosphate and 1 M $CaCl_2$ stock solutions to final concentrations of 5 mM, 0.5 M and 0.1 mM, respectively. The protein was loaded onto the PS column at a flow rate of 100 cm/hr. 5 mM potassium phosphate, 0.5 M ammonium sulfate and 0.1 mM $CaCl_2$ pH 7.0 was added at 100 cm/hr. The flow through was passed through a 0.22 μm final filter into a sterile bag.

The PS-purified protein was the loaded onto an aminophenyl boronate column (ProMedics) (6.3 L resin, Height=20 cm, Diameter=20 cm) that had been equilibrated with 5 column volumes of 5 mM potassium phosphate, 0.5 M ammonium sulfate. The protein was passed through the column at a flow rate of 100 cm/hr, and the column was washed with 5 mM potassium phosphate, 0.5 M ammonium sulfate, pH 7.0. The column was then washed with 20 mM bicine, 100 mM NaCl, pH 9.0 and the protein eluted with 50 mM Hepes, 100 mM NaCl pH 6.9 through a sterile filter and into a 20 L sterile bag. The eluate was tested for bioburden, protein concentration and enzyme activity.

A hydroxyapatite (HAP) column (BioRad) (1.6 L resin, Height=10 cm, Diameter=14 cm) was equilibrated with 5 mM potassium phosphate, 100 mM NaCl, 0.1 mM $CaCl_2$ pH 7.0. Wash samples were collected and tested for pH, conductivity and endotoxin (LAL assay. The aminophenyl boronate purified protein was supplemented with potassium phosphate and $CaCl_2$ to yield final concentrations of 5 mM potassium phosphate and 0.1 mM $CaCl_2$ and loaded onto the HAP column at a flow rate of 100 cm/hr. The column was washed with 5 mM potassium phosphate pH 7.0, 100 mM NaCl, 0.1 mM $CaCl_2$, then 10 mM potassium phosphate pH 7.0, 100 mM NaCl, 0.1 mM $CaCl_2$ pH. The protein was eluted with 70 mM potassium phosphate pH 7.0 and filtered through a 0.22 μm filter into a 5 L sterile storage bag. The eluate was tested for bioburden, protein concentration and enzyme activity.

The HAP-purified protein was then pumped through a 20 nM viral removal filter via a pressure tank. The protein was added to the DV20 pressure tank and filter (Pall Corporation), passing through an Ultipor DV20 Filter with 20 nm pores (Pall Corporation) into a sterile 20 L storage bag. The filtrate was tested for protein concentration, enzyme activity, oligosaccharide, monosaccharide and sialic acid profiling, and process-related impurities. The protein in the filtrate was then concentrated to 1 mg/mL using a 10 kD molecular weight cut off (MWCO) Sartocon Slice tangential flow filtration (TFF) system (Sartorius). The filter was first prepared by washing with a Hepes/saline solution (10 mM Hepes, 130 mM NaCl, pH 7.0) and the permeate was sampled for pH and conductivity. Following concentration, the concentrated protein was sampled and tested for protein concentration and enzyme activity. A 6× buffer exchange was performed on the concentrated protein into the final buffer: 10 mM Hepes, 130 mM NaCl, pH 7.0. The concentrated protein was passed though a 0.22 μm filter into a 20 L sterile storage bag. The protein was sampled and tested for protein concentration, enzyme activity, free sulfhydryl groups, oligosaccharide profiling and osmolarity.

Tables 11 to 17 provide monitoring data related to each of the purification steps described above, for each 3D35M cell lot.

TABLE 11

Q sepharose column data

| Parameter | HUA0406C | HUA0410C | HUA0415C | HUA0420C |
|---|---|---|---|---|
| Load volume (mL) | 10647 | 13524 | 12852 | 20418 |
| Load Volume/Resin Volume ratio | 3.1 | 4.9 | 4.5 | 7.3 |
| Column Volume (mL) | 2770 | 3840 | 2850 | 2880 |
| Eluate volume (mL) | 6108 | 5923 | 5759 | 6284 |
| Protein Conc. of Eluate (mg/mL) | 2.8 | 3.05 | 2.80 | 2.86 |
| Eluate Enzyme Assay (U/mL) | 24493 | 26683 | 18321 | 21052 |
| Enzyme Yield (%) | 65 | 107 | 87 | 76 |

TABLE 12

Phenyl Sepharose column data

| Parameter | HUA0406C | HUA0410C | HUA0415C | HUA0420C |
|---|---|---|---|---|
| Volume Before Stock Solution Addition (mL) | 5670 | 5015 | 5694 | 6251 |
| Load Volume (mL) | 7599 | 6693 | 7631 | 8360 |
| Column Volume (mL) | 9106 | 9420 | 9340 | 9420 |
| Load Volume/Resin Volume ratio | 0.8 | 0.71 | 0.82 | 0.89 |
| Eluate volume (mL) | 16144 | 18010 | 16960 | 17328 |
| Protein Conc of Eluate (mg/mL) | 0.4 | 0.33 | 0.33 | 0.38 |
| Eluate Enzyme Assay (U/mL) | 8806 | 6585 | 4472 | 7509 |
| Protein Yield (%) | 41 | 40 | 36 | 37 |
| Enzyme Yield (%) | 102 | 88 | 82 | 96 |

TABLE 13

Amino Phenyl Boronate column data

| Parameter | HUA0406C | HUA0410C | HUA0415C | HUA0420C |
|---|---|---|---|---|
| Load Volume (mL) | 16136 | 17958 | 16931 | 17884 |
| Load Volume/Resin Volume ratio | 2.99 | 3.15 | 3.08 | 2.98 |
| Column Volume (mL) | 5400 | 5700 | 5500 | 5300 |
| Eluate volume (mL) | 17595 | 22084 | 20686 | 19145 |
| Protein Conc. of Eluate (mg/mL) | 0.0 | 0.03 | 0.03 | 0.04 |
| Protein Conc. of Filtered Eluate (mg/mL) | not tested | 0.03 | 0.00 | 0.04 |
| Eluate Enzyme Assay (U/mL) | 4050 | 2410 | 1523 | 4721 |
| Protein Yield (%) | 0 | 11 | 11 | 12 |
| Enzyme Yield (%) | not determined | 41 | 40 | 69 |

TABLE 14

Hydroxyapatite column data

| Parameter | HUA0406C | HUA0410C | HUA0415C | HUA0420C |
|---|---|---|---|---|
| Volume Before Stock Solution Addition (mL) | 16345 | 20799 | 20640 | 19103 |
| Load Volume/Resin Volume ratio | 10.95 | 13.58 | 14.19 | 12.81 |
| Column Volume (mL) | 1500 | 1540 | 1462 | 1500 |
| Load volume (mL) | 16429 | 20917 | 20746 | 19213 |
| Eluate volume (mL) | 4100 | 2415 | 1936 | 2419 |
| Protein Conc. of Eluate (mg/mL) | not tested | 0.24 | 0.17 | 0.23 |
| Protein Conc. of Filtered Eluate (mg/mL) | NA | NA | 0.17 | NA |
| Eluate Enzyme Assay (U/mL) | 14051 | 29089 | 20424 | 29826 |
| Protein Yield (%) | Not tested | 93 | 53 | 73 |
| Enzyme Yield (%) | 87 | 118 | 140 | 104 |

TABLE 15

DV20 filtration data

| Parameter | HUA0406C | HUA0410C | HUA0415C | HUA0420C |
|---|---|---|---|---|
| Start volume (mL) | 4077 | 2233 | 1917 | 2419 |
| Filtrate Volume (mL) | 4602 | 3334 | 2963 | 3504 |
| Protein Conc. of Filtrate (mg/mL) | 0.1 | NA | 0.09 | NA |
| Protein Conc. of Filtered Eluate (mg/mL) | NA | 0.15 | 0.09 | 0.16 |
| Protein Yield (%) | not tested | 93 | 82 | 101 |

TABLE 16

Final concentration data

| Parameter | HUA0406C | HUA0410C | HUA0415C | HUA0420C |
|---|---|---|---|---|
| Start volume (mL) | 4575 | 3298 | 2963 | 3492 |
| Concentrate Volume (mL) | 562 | 407 | 237 | 316 |
| Protein Conc. of Concentrate (mg/mL) | 0.9 | 1.24 | 1.16 | 1.73 |
| Protein Yield (%) | 111 | 102 | 103 | 98 |

TABLE 17

Buffer Exchange into Final Formulation data

| Parameter | HUA0406C | HUA0410C | HUA0415C | HUA0420C |
|---|---|---|---|---|
| Start Volume (mL) | 562 | 407 | 237 | 316 |
| Final Volume Buffer Exchanged Concentrate (mL) | 594 | 516 | 310 | 554 |
| Protein Conc. of Concentrate (mg/mL) | 1.00 | 0.97 | 0.98 | 1.00 |
| Protein Conc. of Filtered Concentrate (mg/mL) | 0.95 | 0.92 | 0.95 | 1.02 |
| Protein Yield (%) | 118 | 99 | 110 | 101 |

The purified and concentrated soluble rHuPH20 protein was aseptically filled into sterile vials with 5 mL and 1 mL fill volumes. The protein was passed though a 0.22 µm filter to an operator controlled pump that was used to fill the vials using a gravimetric readout. The vials were closed with stoppers and secured with crimped caps. The closed vials were visually inspected for foreign particles and then labeled. Following labeling, the vials were flash-frozen by submersion in liquid nitrogen for no longer than 1 minute and stored at ≤15° C. (−20±5° C.).

EXAMPLE 14

Production of Gen2 Cells Containing Soluble Human PH20 (rHuPH20)

The Gen13D35M cell line described in Example 12 was adapted to higher methotrexate levels to produce generation 2 (Gen2) clones. 3D35M cells were seeded from established methotrexate-containing cultures into CD CHO medium containing 4 mM GlutaMAX™-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the $12^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the $8^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr-) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of ~7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III.

EXAMPLE 15

A. Production of Gen2 Soluble rHuPH20 in 300 L Bioreactor Cell Culture

A vial of HZ24-2B2 was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, the a vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5\times10^6$ cells/mL, the culture was expanded into a 250 mL spinner flask in 200 mL culture volume, and the flask was incubated at 37° C., 7% $CO_2$. When the cell density reached greater than $1.5\times10^6$ cells/mL, the culture was expanded into a 1 L spinner flask in 800 mL culture volume and incubated at 37° C., 7% $CO_2$. When the cell density reached greater than $1.5\times10^6$ cells/mL the culture was expanded into a 6 L spinner flask in 5000 mL culture volume and incubated at 37° C., 7% $CO_2$. When the cell density reached greater than $1.5\times10^6$ cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of $4.0\times10^5$ viable cells per ml and a total volume of 260 L. Parameters were temperature setpoint, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1× CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (1× CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and viral in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 µm and a layer of diatomaceous earth graded to 1.4-1.1 µm, followed by a cellulose membrane, then through a second single Millistak filtration system (Millipore) containing a layer of diatomaceous earth graded to 0.4-0.11 µm and a layer of diatomaceous earth graded to <0.1 µm, followed by a cellulose membrane, and then through a 0.22 µm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filter (Sartorious), followed by a 10× buffer exchange with 10 mM Tris, 20 mM $Na_2SO_4$, pH 7.5 into a 0.22 µm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM Na2SO4, pH 7.5. Following viral inactivation, the concentrated, diafiltered harvest was loaded onto the Q column at a flow rate of 100 cm/hr. The column was washed with 5 column volumes of 10 mM Tris, 20 mM Na2SO4, pH 7.5 and 10 mM Hepes, 50 mM NaCl, pH7.0. The protein was eluted with 10 mM Hepes, 400 mM NaCl, pH 7.0 into a 0.22 µm final filter into sterile bag. The eluate sample was tested for bioburden, protein concentration and hyaluronidase activity. $A_{280}$ absorbance reading were taken at the beginning and end of the exchange.

Phenyl-Sepharose (Pharmacia) hydrophobic interaction chromatography was next performed. A Phenyl-Speharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2M ammonium sulfate, 1 M potassium phosphate and 1 M $CaCl_2$ stock solutions to yield final concentrations of 5 mM, 0.5 M and 0.1 mM, respectively. The protein was loaded. onto the PS column at a flow rate of 100 cm/hr and the column flow thru collected. The column was washed with 5 mM potassium phosphate, 0.5 M ammonium sulfate and 0.1 mM CaCl2 pH 7.0 at 100 cm/hr and the wash was added to the collected flow thru. Combined with the column wash, the flow through was passed through a 0.22 µm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and test for pH, conductivity and endotoxin (LAL assay). The column was equilibrated with 5 mM potassium phosphate, 100 mM NaCl-10.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM CaCl$_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 μm final filter into a sterile bag. The viral filtered sample was tested for protein concentration, enzyme activity, oligosaccharide, monosaccharide and sialic acid profiling. The sample also was tested for process related impurities.

The protein in the filtrate was then concentrated to 10 mg/mL using a 10 kD molecular weight cut off (MWCO) Sartocon Slice tangential flow filtration (TFF) system (Sartorius). The filter was first prepared by washing with 10 mM histidine, 130 mM NaCl, pH 6.0 and the permeate was sampled for pH and conductivity. Following concentration, the concentrated protein was sampled and tested for protein concentration and enzyme activity. A 6× buffer exchange was performed on the concentrated protein into the final buffer: 10 mM histidine, 130 mM NaCl, pH 6.0. Following buffer exchange, the concentrated protein was passed though a 0.22 μm filter into a 20 L sterile storage bag. The protein was sampled and tested for protein concentration, enzyme activity, free sulfhydryl groups, oligosaccharide profiling and osmolarity.

The sterile filtered bulk protein was then aseptically dispensed at 20 mL into 30 mL sterile Teflon vials (Nalgene). The vials were then flash frozen and stored at −20±5° C.

C. Comparison of Production and Purification of Gen1 Soluble rHuPH20 and Gen2 Soluble rHuPH20

The production and purification of Gen2 soluble rHuPH20 in a 300 L bioreactor cell culture contained some changes in the protocols compared to the production and purification Gen1 soluble rHuPH20 in a 100 L bioreactor cell culture (described in Example 13.B). Table 18 sets forth exemplary differences, in addition to simple scale up changes, between the methods.

TABLE 18

| Process Difference | Gen1 soluble rHuPH20 | Gen2 soluble rHuPH20 |
|---|---|---|
| Cell line | 3D35M | 2B2 |
| Media used to expand cell inoculum | Contains 0.10 μM methotrexate (0.045 mg/L) | Contains 20 μM methotrexate (9 mg/L) |
| Media in 6 L cultures onwards | Contains 0.10 μM methotrexate | Contains no methotrexate |
| 36 L spinner flask | No instrumentation 20 L operating volume. | Equipped with instrumentation that monitors and controls pH, dissolved oxygen, sparge and overlay gas flow rate. 32 L operating volume |
| Final operating volume in bioreactor | Approx. 100 L in a 125 L bioreactor (initial culture volume + 65 L) | Approx. 300 L in a 400 L bioreactor (initial culture volume + 260 L) |
| Culture media in final bioreactor | No rHuInsulin | 5.0 mg/L rHuInsulin |
| Media feed volume | Scaled at 4% of the bioreactor cell culture volume i.e. 3.4, 3.5 and 3.7 L, resulting in a target bioreactor volume of ~92 L. | Scaled at 4% of the bioreactor cell culture volume i.e. 10.4, 10.8, 11.2 and 11.7 L, resulting in a target bioreactor volume of ~303 L. |
| Media feed | Feed #1 Medium: CD CHO + 50 g/L Glucose + 8 mM GlutaMAX ™-1 Feed #2 (CD CHO + 50 g/L Glucose + 8 mM GlutaMAX + 1.1 g/L Sodium Butyrate Feed #3: CD CHO + 50 g/L Glucose + 8 mM GlutaMAX + 1.1 g/L Sodium Butyrate | Feed #1 Medium: 4x CD CHO + 33 g/L Glucose + 32 mM Glutamax + 16.6 g/L Yeastolate + 33 mg/L rHuInsulin Feed #2: 2x CD CHO + 33 g/L Glucose + 16 mM Glutamax + 33.4 g/L Yeastolate + 0.92 g/L Sodium Butyrate Feed #3: 1x CD CHO + 50 g/L Glucose + 10 mM Glutamax + 50 g/L Yeastolate + 1.80 g/L Sodium Butyrate Feed #4: 1x CD CHO + 33 g/L Glucose + 6.6 mM Glutamax + 50 g/L Yeastolate + 0.92 g/L Sodium Butyrate |

TABLE 18-continued

| Process Difference | Gen1 soluble rHuPH20 | Gen2 soluble rHuPH20 |
|---|---|---|
| Filtration of bioreactor cell culture | Four polyethersulfone filters (8.0 μm, 0.65 μm, 0.22 μm and 0.22 μm) in series 100 L storage bag | $1^{st}$ stage - Four modules in parallel, each with a layer of diatomaceous earth graded to 4-8 μm and a layer of diatomaceous earth graded to 1.4-1.1 μm, followed by a cellulose membrane. $2^{nd}$ stage - single module containing a layer of diatomaceous earth graded to 0.4-0.11 μm and a layer of diatomaceous earth graded to <0.1 μm, followed by a cellulose membrane. $3^{rd}$ stage - 0.22 μm polyethersulfone filter 300 L storage bag Harvested cell culture is supplemented with 10 mM EDTA, 10 mM Tris to a pH of 7.5. |
| Concentration and buffer exchange prior to chromatography | Concentrate with 2 TFF with Millipore Spiral Polyethersulfone 30K MWCO Filter Buffer Exchange the Concentrate 6× with 10 mM Hepes, 25 mM NaCl, pH 7.0 20 L sterile storage bag | Concentrate using four Sartorius Sartoslice TFF 30K MWCO Filter Buffer Exchange the Concentrate 10× with 10 mM Tris, 20 mM Na2SO4, pH 7.5 50 L sterile storage bag |
| Viral inactivation prior to chromatography | None | Viral inactivation performed with the addition of a 1% Triton X-100, 0.3% Tributyl Phosphate, pH 7.5, |
| $1^{st}$ purification step (Q sepharose) | No absorbance reading | A280 measurements at the beginning and end |
| Viral filtration after chromatography | Pall DV-20 filter (20 nm) | Sartorius Virosart filter (20 nm) |
| Concentration and buffer exchange after chromatography | Hepes/saline pH 7.0 buffer Protein concentrated to 1 mg/ml | Histidine/saline, pH 6.0 buffer Protein concentrated to 10 mg/ml |

EXAMPLE 16

Determination of Hyaluronidase Activity of Soluble rHuPH20

Hyaluronidase activity of soluble rHuPH20 in samples such as cell cultures, purification fractions and purified solutions was determined using a tubidometric assay, which based on the formation of an insoluble precipitate when hyaluronic acid binds with serum albumin. The activity is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 enzymatic activity. The method is run using a calibration curve generated with dilutions of a soluble rHuPH20 assay working reference standard, and sample activity measurements are made relative to this calibration curve.

Dilutions of the sample were prepared in Enzyme Diluent Solutions. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of SWFI, and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not be less than 20 μL. The minimum sample volumes needed to perform the assay were: In-process Samples, FPLC Fractions: 80 μL; Tissue Culture Supernatants: 1 mL; Concentrated Material 80 μL; Purified or Final Step Material: 80 μL. The dilutions were made in triplicate in a Low Protein Binding 96-well plate, and 30 μL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 μL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the plate to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes The MULTIDROP 384 was prepared to stop the reaction by priming the machine with Serum Working Solution and changing the volume setting to 240 µL. (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384 and 240 µL of serum Working Solutions was dispensed into the wells. The plate was removed and shaken on a plate reader for 10 seconds. After a further 15 minutes, the turbidity of the samples was measured at 640 nm and the enzyme activity (in U/mL) of each sample was determined by fitting to the standard curve.

Specific activity (U/mg) was calculated by dividing the enzyme activity (U/ml) by the protein concentration (mg/mL).

EXAMPLE 17

Cathepsin-L Severs Fibrous Septae in the Subcutaneous Space of Zucker Rats

Zucker rats were treated by administration of 90 µg/ml cathepsin-L in MES buffer, pH 5.3 and histology performed on skin sections to visualize the fibrous septae. As a control, rats were treated with MES buffer, pH 5.3 alone. Sections were fixed and stained with Masson's Trichrome staining for visualization of collagen as described in Example 5. Sections also were stained with Hemotoxylin and Eosin. Briefly, sections were deparaffinzed and hydrated to water. If the sections were Zenker-fixed, the mercuric chloride crystals were removed with iodine and cleared with sodium thiosulphate. Samples were stained with Mayer's hematoxylin for 15 minutes, followed by washing in running tap water for 20 minutes. The sections were counter-stained with eosin for 15 seconds to 2 minutes depending on the age of the eosin, and the depth of the counterstain desired. For even staining results, the slides were dipped several times before allowing them to set in the eosin. The sections were dehydrated in 95% and absolute alcohols with two changes of two minutes each until excess eosin was removed. The slides were checked under a microscope before being cleared in xylene with two changes of two minutes each. Sections were mounted in Permount or Histoclad. The results show that in control animals treated with acidic buffer only, the hypodermal adipose lobules were separated by a complex network of collagen fibrous septae extending perpendicularly to the skin surface. Treatment of rats with cathepsin-L results in degradation of the hypodermis fibrous septae.

The organization of the fibrous septae was further visualized with a rabbit anti-collagen antibody following treatment with MES buffer, pH 5.3 without cathepsin-L, with 90 µg/ml cathepsin-L or with 90 µg/ml bacterial collagenase in 50 mM HEPES buffer, pH 7.4. The results show a normal collagen distribution in control rats treated with acidic MES buffer only. Treatment of rats with cathepsin-L showed a decreased staining for collagen evidencing degradation of collagen. The degradation of collagen, however, was much more pronounced by treatment of rats with bacterial collagenase. These results demonstrate that cathepsin-L has a greater temporal control of collagen degradation compared to bacterial collagenase.

EXAMPLE 18

Duration of Enzymatic Action of Cathepsin-L in Zucker Rat Dermis

The duration of the enzymatic action of cathepsin-L was assessed in the dermis of Zucker rat using two complementary methods: Western blots and enzymatic activity. Rats were injected in the dermis with 1 mL of 1200 units/ml of rHuPH20, pH 5.3, containing epinephrine (2.5 ug/mL) to induce vascular contraction. This was immediately followed by an injection of 1 mL of 100 µg/mL of recombinant cathepsin-L, pH 5.3, in 50 mM MES buffer. Incisions were made in the injection site and interstitium perfusate was collected from 3 to 70 minutes post-injection with a 20 µL and 200 µL Eppendorf pipet. The fluid was analyzed by Western blot analysis for collagen degradation as described in Example 10 and by measuring the enzymatic activity of cathepsin-L as determined from the rate of hydrolysis of a commercially available fluorogenic substrate, which activity is expressed as relative fluorescence units (RFU)/minute, designated as Z-Leu-Arg-AMC, over one hour as described in Example 9. pH values of the interstitial fluid perfusate was recorded using pH indicator strips (EMD Chemicals, Inc., Gibbstown, N.J., Cat#9588). The data are shown in Table 19.

Maximal enzymatic activity was measured within 10 minutes post treatment. Activity decreased by about 50% at 30 min and about 70% at 60 min following the administration in the dermis.

TABLE 19

Time after administration in relation with cathepsin-L activity and pH of the interstitium fluid following administration of 100 µg/mL of recombinant cathepsin-L, pH 5.3.

| Time (min post injection) | Cathepsin-L activity (RFU/min) | pH of the perfusate |
| --- | --- | --- |
| 9 | 1930 | 5-5.5 |
| 12 | 1917 | 5-5.5 |
| 15 | 1759 | 5-5.5 |
| 18 | 1261 | 5-5.5 |
| 21 | 1165 | 5-5.5 |
| 25 | 1115 | 5.5 |
| 30 | 950 | 5.5-6 |
| 40 | 669 | 5.5-6 |
| 60 | 636 | 6 |

EXAMPLE 19

Dose-Response Effect of Cathepsin-L on Collagen Degradation in Zucker Rat Dermis Following administration of 1 ml of 1200 U/ml of rHuPH20, pH 5.3 in the dermis of Zucker rats, 1 ml of cathepsin-L doses ranging from 1 µg/mL to 500 µg/mL were administered into the dermis of Zucker rats. Twenty minutes post-injection, biopsies were collected, fixed in Bouin's fixative, and processed for histology. Sections were stained with Hematoxylin and Eosin, and Masson's Trichrome for visualization of collagen as described in Example 5. Incisions were made with a scalper in the injection site and interstitium fluid was collected.

Histological analysis of the treated skin and Western blot analysis of the perfusates were carried out as described in Examples 5 and 10, respectively. An aliquot of 25 µL of interstitium fluid was mixed with 5 µL of 6× gel loading sample buffer for SDS-PAGE. The total volume of samples were loaded onto 4-12% Tris-Glycine gels (Invitrogen, Carlsbad, Calif., Cat# EC6038) and electrophoresis was carried out in Tris-Glycine SDS running buffer until the dye front of the prestained molecular weight markers (Invitrogen, Cat# LC5925) reached the bottom of the gel. The proteins were transferred onto a nitrocellulose membrane (Invitrogen, Cat#LC2001) using the XCell II Blot module (Invitrogen, Cat# IB1001) at 20V for 1.5 hours at 4° C. in a buffer of 20% Methanol, 25 mM Tris, and 220 mM Glycine. Transfer was verified by the almost complete absence of color of the prestained marker bands on the gel. The membrane was blocked in a buffer consisting of 2% non fat dry milk in PBST (phosphate-buffered saline (PBS) solution (137 mM NaCl, 2.7 mM KCl, 10 mM phosphate, pH 7.4), with the detergent Tween 20 (0.05% v/v) for use as a wash buffer and diluent for ELISA) for 30 minutes at room temperature. Collagen I was detected with a rabbit polyclonal antibody to human collagen I (Abcam, Cambridge, Mass., Cat#ab34710) used at 1 µg/mL final concentration in PBST and incubated at room temperature for 1 hour followed by a HRP conjugated goat anti-rabbit IgG (Calbiochem, San Diego, Calif., Cat#DC03L) used at a concentration of 33 ng/mL in PBST for 1 hr at room temperature. The HRP signal was developed by the TMB Insoluble (Calbiochem, Cat# 613548) membrane development solution and the reaction was stopped by rinsing in ddH2O after 5-10 minutes at room temperature.

Histological and western blot analysis showed that increased doses of cathepsin-L resulted in dose dependent collagen degradation. Western blot analysis indicated that higher concentrations of cathepsin-L resulted in more extensive collagen degradation as judged by the presence of numerous low molecular weight bands in the samples treated with 100 µg/mL.

EXAMPLE 20

Dose-Dependent Effect of Cathepsin-L on Fibrous Septae Disruption

Following administration of 1 mL of 1200 U/ml of rHuPH20 in 50 mM MES, 150 mM NaCl, pH 5.3, Zucker rats were administered 1 mL of human recombinant cathepsin-L doses ranging from 1, 10, 50, 100, 250, and 500 µg/mL in MES buffer, pH 5.3, to the dermis. As a control, rats were treated with MES buffer, pH 5.3, alone. Twenty minutes post injection, the interstitium perfusates were collected from the injection sites as described in Example 18. Skin biopsies were collected, fixed in Bouin's fixative and processed for histology. Deparaffined sections were stained with Hematoxylin and Eosin, and Masson's Trichrome for visualization of collagen as described in Example 5. Western blots were carried out as described in Example 10.

Results from histology and Western blot analysis showed that recombinant cathepsin-L degradation of collagen in the Zucker rat was dose dependent. Disruption of the fibrous septae was clearly visible in the skin treated with 10 µg/mL of cathepsin-L.

EXAMPLE 21

Effect of Ionic Strength on the Effect of Cathepsin-L in Zucker Rat Dermis

The time period of cathepsin-L enzymatic activity injected in the dermis was studied as a function of the ionic strength of the buffer and epinephrine.

Zucker rats were injected with 1 mL of 1200 U/ml rHuPH20 followed by 1 mL of 25 µg/mL cathepsin-L in 1, 5, 10 and 50 mM of MES buffer, 150 mM NaCl, pH 5.3. The interstitium perfusate was collected at 20 minutes post administration. pH values of the interstitial fluid perfusate was recorded using pH indicator strips (EMD Chemicals, Inc., Gibbstown, N.J., Cat#9588) and cathepsin-L enzymatic activity in the dermis was measured as described in Example 9. pH values of the dermal perfusate was 7.5 for the low ionic buffer strength (1, 5, and 10 mM MES, pH5.3). pH value of the dermal perfusate was 6.5 when cathepsin-L was delivered in 50 mM MES, pH 5.3. No measurable enzymatic activity was detected when cathepsin-L was delivered in low ionic buffer strength (1, 5, and 10 mM MES). Robust enzymatic activity was detected in the perfusate of injection site administered with cathepsin-L formulated in 50 mM MES. These results indicated that the enzymatic activity of cathepsin-L can be tightly modulated by the ionic strength of the buffer.

EXAMPLE 22

Disruption of Fibrous Septae by Cathepsin-L Injected into Zucker Rat Subdermis The effect of one single dose of cathepsin-L injected into the subdermis of Zucker rat was assessed in 22 Male Zucker rats treated with either 10 or 100 µg/mL cathepsin-L in 50 mM MES buffer, 150 mM NaCl, pH 5.3 following administration of 1200 U/ml of rHuPH20 in 50 mM MES, 150 mM NaCl, pH 5.3. Biopsies were taken once a week for a period of 20 weeks and analyzed histologically as described in Example 5. A single treatment with either 10 µg/ml or 100 µg/ml dose of cathepsin-L resulted in rapid disruption of the fibrous septae as described in Example 17. Histological analysis of biopsies taken at week 4 indicated that the number of fibrous septae was lower in the treated areas than in the nontreated areas. From week 20 on, the typical vertical orientation of the fibrous septae was not seen in the treated areas. Rather, the orientation of the collagen in the hypodermis was horizontal and parallel to the skin surface, consistent with tissue remodeling.

EXAMPLE 23

Administration of Cathepsin-L is not Associated with Adverse Effects

Safety study of cathepsin L injected intravascularly shows no obvious adverse effects. 25 g Male balb/c mice (Charles River) and 200 g male Sprague Dawley rats (Harlan Laboratories) were administered recombinant cathepsin L in 50 mM MES, 150 mM NaCl, pH 5.3 at concentrations up to 12 mg/kg in the tail vein. Animals were observed for one week for adverse effects. No adverse effect recorded by cage side observation.

EXAMPLE 24

Cathepsin-L Alters the Structure of the Fibrous Septae Microarchitecture in the Pig Hypodermis Anesthetized Yorkshire pigs (SNS farms, Ramona, Ca) received 5 mL of 50 mM MES, 150 mM NaCl buffer at pH 5.3 containing 1200 U/mL of rHuPH20 through a 23-gauge butterfly needle (Terumo, Leuven, Belgium Cat#CE0197) inserted into the hypodermis of the flank, immediately followed by i) 5 mL of 50 µg/ml cathepsin-L in 50 mM MES, 150 mM NaCl buffer, pH 5.3; or ii) 50 µg bacterial collagenase in 50 mM HEPES, 150 mM NaCl buffer, pH 7.4. Controls were 50 mM MES buffer, 150 mM NaCl pH 5.3; rHuPH20 alone pH 5.3; and cathepsin-L at pH 7.4. Full thickness biopsies were harvested at 2 hours, 24 hours and seven days post treatment and fixed in Bouin's fixative. Six mm histological sections were cut and stained with Hematoxylin and Eosin or with Mason Trichrome collagen stain. Gross changes characterized by intense brown discoloration were observed in the collagenase injected sites, but to a much lesser degree in the cathepsin-L treated site. No gross changes were seen at the sites injected with the controls or in the untreated skin. These results show that treatment with cathepsin-L is accompanied with minimal bleeding compared to bacterial collagenase injection.

Gross changes typically correlated with histological findings of substantial subcutaneous injection site bleeding with collagenase, but minimal bleeding with cathepsin-L. The micro-architecture of fibrous septae was characterized by longitudinal splitting, disintegration and angulation of the collagen fibers in the skin injected with cathepsin-L and bacterial collagenase, compared to the densely packed collagen septae in the MES buffer only treated skin. The histology results, however, did show a more severe change in the micro architecture of the septae in the collagenase-treated site compared to the cathepsin-L treated site, consistent with the hemorrhage results. In addition, treatment with doses of bacterial collagenase as low as 5 µg/mL resulted in serious rhabdomyolysis. These results demonstrate that while cathepsin-L degrades collagen and alters the structure of the fibrous septae, its effects are more controlled then bacterial collagenase because cathepsin-L is rapidly inactivated at physiological pH whereas collagenase is active for a prolonged period of time at physiological pH.

In another study, pigs received 5 mL of 120/ml U rHuPH20 at pH 5.3 followed by 5 mL of recombinant cathepsin-L in doses ranging from 5 to 1000 µg/mL (5, 25, 50, 100, 200, 500, and 1000 µg/mL) in 50 mM MES, 150 mM NaCl, pH 5.3. Full thickness skin biopsies were harvested at 2 and 24 hr post treatment, fixed in Bouin's fixative and processed for H&E or with Masson's Trichrome for collagen stain as described in Example 5. Visual examination of the skin excised 2 hours and 24 hours after injection showed that there was a moderate bleeding at the injection site treated with doses of 25 µg/mL and above. Rhamdomyolysis was observed only in the injection sites area at the high doses of 500 µg/mL and 1000 µg/mL of recombinant cathepsin-L.

EXAMPLE 25

Effect of Reducing Conditions on Enzymatic Activity of Cathepsin-L for a Fluorogenic Substrate The effect of reducing agents on the enzymatic activity of cathepsin-L was assayed using a custom manufactured fluorogenic substrate, designated Z-His-Arg-Tyr-Arg-AMC (SEQ ID NO: 536; Z=:N-carbobenzyloxy; AMC: 7-Amino-4-Methyl Coumarin) (Biomatik Corp., Wilmington, Del.). Cathepsin-L activity in RFU/Sec was determined in the presence of cysteine (Spectrum Chemical, Gardena, Calif.; Catalog #C1473) or TCEP (tris (2-carboxyethyl)phosphine) (Sigma Aldrich, St. Louis, Mo. Cat#C4706).

Activatated cathepsin-L at a stock concentration of 7.85 mg/mL containing 5 mM Cysteine was used. 2 ng/ml cathepsin-L was incubated with 20 µM fluorogenic peptide substrate Z-His-Arg-Tyr-Arg-AMC at 37° C. for 30 minutes at 37° C. in a total volume of 200 µl 50 mM Sodium Citrate buffer pH 6.5, 2% DMSO, 0.01% Brij-35 containing the appropriate concentration of cysteine or TCEP as indicated in Table 19A. Incubations were performed in an opaque-bottom microplate. The resulting fluorescence was read at the optimum excitation emission 360 nm-460 nm for the substrate in a fluorescent plate reader (Molecular Devices, Spectramax M5, Sunnyvale, Calif.). After sigrnoidal dose response fits in Graphpad Prizm software (Graphpad Software, La Jolla, Calif.), the curve fits had R2 values >0.998. The results shown in Table 19A below indicate that the presence of a reducing agent increases the activity of cathepsin-L

TABLE 19A

Effect of Reducing Agents on Cathepsin-L activity

| | Activity RFU/Second | % Max Activity |
|---|---|---|
| µM Reductant (Cysteine) | | |
| 10000 | 413.577 | 99.7% |
| 3333 | 414.853 | 100.0% |
| 1111 | 303.383 | 73.1% |
| 370 | 101.905 | 24.6% |
| 123 | 17.821 | 4.3% |
| 41 | 3.310 | 0.8% |
| 14 | 1.384 | 0.3% |
| µM Reductant (TCEP) | | |
| 10000 | 358.5 | 88.4% |
| 3333 | 405.4 | 100.0% |
| 1111 | 399.5 | 98.5% |
| 370 | 385.1 | 95.0% |
| 123 | 388.9 | 95.9% |
| 41 | 331.9 | 81.9% |
| 14 | 172.1 | 42.5% |
| 4.6 | 26.7 | 6.6% |
| 1.5 | 0.7 | 0.2% |

EXAMPLE 26

Enzymatic Activity of Cathepsin-L on Substrates

Cathepsin-L at a concentration of 0.25 mg/ml was incubated with either one of the following three proteins (Collagen Type I at 0.5 mg/ml; HSA at 0.25 mg/ml; and PH20 at 0.25 mg/ml) or as a mixture of two or three at 37° C. for up to 16 hours in a buffer containing either 50 mM sodium acetate pH 5, 50 mM sodium acetate pH 6 or 50 mM Hepes pH 7. At various time points (0, 15 min, 30 min, 60 min, 120 min, 240 min, and overnight), aliquots of samples were taken and analyzed by SDS-PAGE using blue staining. Protein degradation by cathepsin-L was dose-dependent and was observed for each of the substrates tested by a visual decrease in the intensity of the intact protein. Degradation of collagen Type I, HAS and PH20 by cathepsin L was more complet at pH 5. The degradation diminished at pH 6 and above. At neutral pH, the degradation of collagen Type I, HAS and PH20 by cathepsin L was minimal. Since cathepsin L is stable at pH 5, adding a reducing agent to the buffer had little or no effect on the degradation of collagen, HAS and PH20 by cathepsin L at pH 5. Since cathepsin L undergoes autocatalysis as the pH is increased to neutral, adding a reducing agent at neutral pH decreased the autocatalysis of cathepin L and thereby increased the degradation of collagen, HAS and PH20.

EXAMPLE 27

Cloning and Expression of hMMP-1

A. Cloning and High-Throughput Expression of hMMP-1 Library

In this example, a human matrix metalloprotease 1 (hMMP-1) library was created by cloning DNA encoding human MMP-1 into a plasmid followed by transformation and protein growth/isolation. The library was created by introducing mutations in a parent human MMP-1 DNA sequence having the sequence of nucleotides set forth in SEQ ID NO: 534, which encodes the inactive zymogen proMMP-1 (set forth in SEQ ID NO: 327), to generate single amino acid variants of MMP-1 across the catalytic domain and proline rich linker domain of the polypeptide. The hMMP-1 library was designed to contain at least 15 amino acid variants at each of 178 amino acids positions within the catalytic domain (amino acids 81-242 of SEQ ID NO: 327) and the linker region (amino acids 243-258 of SEQ ID NO: 327) of human MMP-1 (See Table 20, below).

TABLE 20 hMMP-1 Library

| Amino Acid | Amino Acid Substitutions |
|---|---|
| F81 | E; H; R; C; Q; T; S; G; M; W; I; V; L; A; P |
| V82 | R; C; N; Q; T; Y; S; G; F; M; W; I; L; A; P |
| L83 | D; E; H; R; C; Q; T; Y; S; G; M; W; I; A; P |
| T84 | D; E; H; R; C; Q; Y; S; G; F; I; V; L; A; P |
| E85 | K; R; C; N; Q; T; Y; S; G; F; M; V; L; A; P |
| G86 | D; H; K; C; N; T; Y; S; F; M; W; I; V; L; P |
| N87 | E; H; R; C; Q; Y; S; G; F; M; I; V; L; A; P |
| P88 | D; E; H; K; R; C; Q; T; Y; G; W; I; V; L; A |
| R89 | E; H; K; N; T; Y; S; G; F; M; W; V; L; A; P |
| W90 | E; H; R; N; Q; T; S; G; F; M; I; V; L; A; P |
| E91 | D; H; R; C; N; T; Y; S; G; F; W; I; V; L; A |
| Q92 | E; K; R; N; T; Y; S; G; W; I; V; L; A; P |
| T93 | D; E; K; R; N; S; G; F; M; W; I; V; L; A; P |
| H94 | D; E; R; N; T; S; G; F; M; W; I; V; L; A; P |
| L95 | D; E; H; K; R; C; T; Y; S; G; W; I; V; A; P |
| T96 | E; H; R; C; N; Q; S; G; F; W; I; V; L; A; P |

TABLE 20-continued hMMP-1 Library

| Amino Acid | Amino Acid Substitutions |
|---|---|
| Y97 | D; E; H; K; R; N; Q; T; S; G; W; V; L; A; P |
| R98 | D; E; H; K; C; Y; S; G; F; M; W; V; L; A; P |
| I99 | E; H; R; C; N; Q; T; Y; S; G; F; W; V; L; A; P |
| E100 | D; H; R; N; T; Y; S; G; F; M; W; I; V; L; P |
| N101 | D; H; K; R; C; T; Y; S; F; M; W; V; L; A; P |
| Y102 | D; E; K; R; C; N; Q; S; G; F; M; V; L; A; P |
| T103 | D; E; K; R; C; N; Q; Y; S; G; W; V; L; A; P |
| P104 | D; E; H; R; C; Q; T; Y; S; G; F; M; V; L; A |
| D105 | E; R; C; N; T; S; G; F; M; W; I; V; L; A; P |
| L106 | D; H; R; C; N; T; Y; S; G; F; M; I; V; A; P |
| P107 | D; K; R; C; T; Y; S; G; F; M; W; I; V; L; A |
| R108 | E; K; C; N; T; Y; S; G; F; W; I; V; L; A; P |
| A109 | D; E; H; R; N; Q; T; Y; S; G; M; W; I; V; L |
| D110 | H; R; C; Q; T; Y; S; G; F; M; I; V; L; A; P |
| V111 | D; E; K; R; C; Q; T; Y; S; G; W; I; L; A; P |
| D112 | H; K; R; C; Q; T; Y; S; G; F; M; W; I; V; L; A; P |
| H113 | D; E; R; N; T; Y; S; G; F; M; W; V; L; A; P |
| A114 | E; R; C; N; Q; T; S; G; F; M; W; I; V; L; P |
| I115 | D; E; H; K; R; C; Q; T; S; G; F; W; V; L; P |
| E116 | D; H; K; R; C; N; Q; S; G; F; M; I; L; A; P |
| K117 | D; E; H; R; N; Q; T; Y; S; G; F; W; L; A; P |
| A118 | D; E; H; K; R; Q; T; S; G; F; W; I; V; L; P |
| F119 | E; H; K; R; C; N; T; Y; S; G; W; V; L; A; P |
| Q120 | D; E; H; K; R; C; N; T; Y; G; M; W; V; L; P |
| L121 | E; H; K; R; C; N; Q; T; S; G; F; I; V; A; P |
| W122 | E; H; K; R; N; Q; T; Y; S; G; F; V; L; A; P |
| S123 | D; H; K; R; C; N; Q; T; Y; G; F; M; W; I; V; L; A; P |
| N124 | D; K; R; C; T; S; G; F; M; W; I; V; L; A; P |
| V125 | D; E; H; R; C; Q; T; Y; S; G; F; M; W; A; P |
| T126 | E; H; K; R; N; Q; S; G; F; M; W; V; L; A; P |
| P127 | E; H; K; R; C; Q; T; S; F; M; W; I; V; L; A |
| L128 | D; K; R; C; Q; T; S; G; F; M; W; I; V; A; P |
| T129 | E; H; K; R; C; Y; S; G; F; M; I; V; L; A; P |
| F130 | E; H; K; R; C; N; T; Y; S; G; I; V; L; A; P |
| T131 | D; E; H; R; C; Q; Y; S; G; F; M; I; V; L; A; P |
| K132 | D; E; H; R; T; Y; S; G; F; M; I; V; L; A; P |

TABLE 20-continued hMMP-1 Library

| Amino Acid | Amino Acid Substitutions |
|---|---|
| V133 | D; E; H; K; R; C; N; T; S; G; M; W; L; A; P |
| S134 | D; E; H; K; R; C; N; Q; T; Y; G; V; L; A; P |
| E135 | D; H; R; N; Q; T; S; F; M; W; I; V; L; A; P |
| G136 | D; E; H; R; C; N; T; S; M; W; I; V; L; A; P |
| Q137 | E; H; K; R; C; N; T; Y; S; G; F; W; L; A; P |
| A138 | D; E; H; R; C; Q; T; S; G; M; W; I; V; L; P |
| D139 | E; H; R; C; N; Y; S; G; F; M; W; I; V; L; A; P |
| I140 | D; E; H; K; R; C; T; Y; G; F; M; W; V; L; A |
| M141 | D; E; H; R; C; N; T; Y; S; G; W; I; L; A; P |
| I142 | K; R; N; Q; T; Y; S; G; F; M; W; V; L; A; P |
| S143 | E; H; R; C; N; Q; T; Y; G; M; W; I; L; A; P |
| F144 | E; H; K; R; C; N; Q; T; S; G; M; W; I; V; L; P |
| V145 | D; E; H; K; R; C; N; Q; T; S; G; W; L; A; P |
| R146 | D; E; H; K; C; N; Q; T; Y; S; F; V; L; A; P |
| G147 | E; H; R; C; Q; T; S; F; M; W; I; V; L; A; P |
| D148 | E; K; R; C; N; T; S; G; M; W; I; V; L; A; P |
| H149 | E; R; C; N; Q; T; Y; S; G; W; I; V; L; A; P |
| R150 | D; E; H; K; N; T; S; G; M; W; I; V; L; A; P |
| D151 | K; R; N; Q; T; Y; S; G; F; M; W; V; L; A; P |
| N152 | D; H; K; R; C; T; Y; S; G; F; W; I; V; L; A; P |
| S153 | D; H; K; R; C; Q; T; Y; G; F; I; V; L; A; P |
| P154 | H; K; R; C; N; Q; T; Y; S; F; W; I; V; L; A |
| F155 | E; H; R; N; Q; T; Y; S; G; M; W; I; V; L; A; P |
| D156 | E; H; K; R; C; T; Y; S; G; M; W; I; V; L; A; P |
| G157 | D; H; K; R; N; Q; T; S; F; M; W; I; V; L; A; P |
| P158 | D; K; R; C; N; Q; T; Y; S; G; F; W; I; V; L; A |
| G159 | E; K; R; C; Q; T; Y; S; M; W; I; V; L; A; P |
| G160 | E; H; R; C; N; Q; T; S; M; W; I; V; L; A; P |
| N161 | E; H; R; C; Q; T; Y; S; G; F; W; I; V; L; P |
| L162 | D; E; R; C; Q; T; Y; S; G; F; M; W; I; A; P |
| A163 | E; K; R; C; N; Q; T; Y; S; G; F; I; V; L; P |
| H164 | E; K; R; C; N; Q; Y; S; G; F; M; V; L; A; P |
| A165 | D; H; K; R; N; Q; T; S; G; F; M; W; I; V; L; P |
| F166 | E; H; K; R; C; N; S; G; M; W; I; V; L; A; P |
| Q167 | D; E; K; R; N; T; Y; S; G; F; M; V; L; A; P |
| P168 | D; H; R; C; N; T; S; G; F; M; W; I; V; L; A |
| G169 | D; E; H; R; C; Q; T; S; M; W; I; V; L; A; P |
| P170 | D; H; K; R; C; Q; T; S; G; F; M; W; I; L; A |
| G171 | D; E; H; K; R; C; N; Q; Y; S; M; W; L; A; P |
| I172 | D; E; R; C; N; Q; T; Y; G; M; W; V; L; A; P |
| G173 | D; K; R; C; N; T; Y; S; F; M; W; V; L; A; P |
| G174 | D; E; H; R; N; T; Y; S; F; M; W; V; L; A; P |
| D175 | E; H; R; C; N; Q; T; Y; S; G; F; I; V; L; A; P |
| A176 | D; E; K; R; C; N; Q; T; S; G; F; W; V; L; P |
| H177 | D; R; C; N; Q; T; Y; S; G; W; I; V; L; P |
| F178 | E; H; K; R; C; Q; T; Y; S; G; W; I; V; L; A; P |
| D179 | E; K; R; C; N; Q; T; S; G; W; I; V; L; A; P |
| E180 | D; K; R; C; N; Q; T; Y; S; G; F; M; I; A; P |
| D181 | E; K; R; C; Q; T; Y; S; G; F; M; I; A; P |
| E182 | D; R; C; Q; T; Y; S; G; F; M; W; I; L; A; P |
| R183 | E; H; K; C; N; T; S; G; M; W; I; V; L; A; P |
| W184 | E; H; R; N; Q; T; S; G; F; M; I; V; L; A; P |
| T185 | D; E; H; R; C; Q; Y; S; G; W; V; L; A; P |
| N186 | D; E; H; R; C; Q; T; Y; S; G; F; V; L; A; P |
| N187 | D; H; K; R; C; T; S; G; M; W; I; L; A; P |
| F188 | D; E; H; K; R; N; Q; S; G; W; I; V; L; A; P |
| R189 | D; E; H; K; C; N; Q; T; Y; G; W; V; L; A; P |
| E190 | D; H; K; R; C; T; Y; S; G; M; I; V; L; A; P |
| Y191 | D; E; H; K; R; C; Q; T; S; G; W; V; L; A; P |
| N192 | D; H; K; R; C; Q; T; S; G; M; W; V; L; A; P |
| L193 | D; E; K; R; N; Q; T; Y; S; G; F; W; I; A; P |
| H194 | E; K; Q; T; Y; S; G; F; M; W; I; V; L; A; P |
| R195 | D; E; K; C; Q; T; Y; S; G; F; W; V; L; A; P |
| V196 | D; E; H; K; R; Q; T; Y; S; G; M; I; L; A; P |
| A197 | E; H; R; C; N; Q; T; Y; S; G; W; I; V; L; P |
| A198 | D; E; H; K; R; T; Y; S; G; F; M; W; V; L; P |
| H199 | E; K; R; C; N; T; S; G; M; W; I; V; L; A; P |
| E200 | D; R; C; N; T; Y; S; G; F; M; W; V; A; P |
| L201 | D; E; K; R; N; Q; T; S; G; M; W; I; V; A; P |
| G202 | D; E; H; K; R; C; T; Y; S; M; I; V; L; A; P |
| H203 | D; E; R; C; N; Q; T; Y; S; G; I; V; L; A; P |
| S204 | D; H; K; R; N; T; Y; G; W; I; V; L; A; P |
| L205 | D; E; R; C; N; Q; T; S; G; M; W; I; V; A; P |
| G206 | D; E; H; R; C; Q; T; S; M; W; I; V; L; A; P |

TABLE 20-continued hMMP-1 Library

| Amino Acid | Amino Acid Substitutions |
|---|---|
| L207 | D; H; K; R; N; Q; Y; S; G; M; W; I; V; A; P |
| S208 | D; E; K; R; C; N; Q; T; G; F; W; V; L; A; P |
| H209 | D; R; C; N; Q; T; Y; S; G; F; W; V; L; A; P |
| S210 | H; K; R; C; N; Q; T; G; F; W; I; V; L; A; P |
| T211 | D; H; K; R; N; Q; S; G; F; M; W; V; L; A; P |
| D212 | E; H; K; R; N; Q; T; Y; S; G; F; V; L; A; P |
| I213 | D; E; H; K; R; C; N; Q; T; S; G; F; M; V; L; A; P |
| G214 | D; E; R; C; Q; T; Y; S; F; M; I; V; L; A; P |
| A215 | D; H; K; R; C; N; Q; T; S; G; M; W; I; V; L; P |
| L216 | D; E; K; R; C; Q; T; S; G; M; W; I; V; A; P |
| M217 | D; H; K; R; C; N; Q; T; Y; S; G; I; L; A; P |
| Y218 | D; E; R; C; N; Q; S; C; F; W; I; V; L; A; P |
| P219 | D; E; H; K; R; C; Q; T; S; G; F; W; V; L; A |
| S220 | E; H; K; R; N; Q; T; G; F; M; I; V; L; A; P |
| Y221 | E; K; R; C; N; Q; T; S; G; M; W; V; L; A; P |
| T222 | D; H; R; C; N; Y; S; G; F; M; W; I; V; L; A; P |
| F223 | E; H; K; R; C; N; Q; T; Y; S; G; M; L; A; P |
| S224 | D; H; K; R; C; Q; T; G; M; W; I; V; L; A; P |
| G225 | D; E; H; K; R; C; N; Q; T; S; M; W; V; A; P |
| D226 | E; H; R; C; N; T; S; G; M; W; I; V; L; A; P |
| V227 | D; E; H; K; R; C; Q; T; Y; S; G; W; L; A; P |
| Q228 | D; E; H; K; R; N; T; Y; S; G; M; W; L; A; P |
| L229 | D; E; H; R; C; Q; T; Y; G; M; W; I; V; A; P |
| A230 | D; H; K; R; C; N; T; Y; S; G; M; W; I; V; L; P |
| Q231 | D; H; R; C; Y; S; G; F; M; W; I; V; L; A; P |
| D232 | E; H; K; R; N; Q; T; Y; S; G; F; W; V; L; A; P |
| D233 | E; K; R; N; Q; T; S; G; M; W; I; V; L; A; P |
| I234 | D; E; H; C; N; Q; Y; G; M; W; V; L; A; P |
| D235 | E; H; R; C; N; Q; T; Y; S; G; I; V; L; A; P |
| G236 | D; E; K; R; C; N; T; Y; S; F; M; I; V; L; P |
| I237 | D; E; K; R; C; N; Q; T; Y; S; G; W; L; A; P |
| Q238 | E; H; K; R; C; N; T; Y; S; G; F; W; I; L; P |
| A239 | D; H; K; R; C; Q; T; Y; S; G; F; W; I; V; L; P |
| I240 | D; K; R; C; Q; T; Y; S; G; F; M; V; L; A; P |
| Y241 | D; H; R; N; Q; T; S; G; M; W; I; V; L; A; P |
| G242 | E; H; K; R; N; T; Y; S; F; W; I; V; L; A; P |
| R243 | D; H; K; C; N; Q; T; Y; S; G; I; V; L; A; P |
| S244 | D; E; H; R; Q; T; Y; G; F; M; W; V; L; A; P |
| Q245 | E; H; K; R; C; T; S; G; F; M; W; I; V; L; P |
| N246 | D; K; R; C; Q; T; Y; S; G; F; W; I; V; L; A; P |
| P247 | D; E; H; K; R; N; Q; T; S; G; F; I; V; L; A |
| V248 | E; H; K; R; C; Q; T; Y; S; G; F; M; W; I; L; A |
| Q249 | E; H; K; R; C; N; T; Y; G; W; I; V; L; A; P |
| P250 | D; K; R; N; Q; T; Y; S; G; F; M; W; V; L; A |
| I251 | D; E; K; R; C; Q; T; Y; S; G; W; V; L; A; P |
| G252 | D; E; H; K; R; C; T; S; F; M; W; I; V; L; A; P |
| P253 | E; K; R; C; N; Q; T; Y; G; M; W; I; V; L; A |
| Q254 | D; E; R; C; T; Y; S; G; F; W; I; V; L; A; P |
| T255 | E; H; K; R; C; N; Q; S; G; F; I; V; L; A; P |
| P256 | E; K; R; C; N; Q; Y; S; G; F; M; I; V; L; A |
| K257 | E; R; C; N; T; S; G; F; M; W; I; V; L; A; P |
| A258 | D; E; R; N; Q; T; Y; G; F; M; W; I; V; L; P |

The cDNA encoding each individual hMMP-1 mutant was generated by changing the wild type codon, encoding each of the 178 amino acids positions identified in Table 21 below, to a codon encoding the desired amino acid substitution. The wild type codons are set forth in SEQ ID NO:534. SEQ ID NO: 534 also depicts the encoded amino acids. The amino acids substitutions and corresponding mutated codons are listed in Table 21, below.

TABLE 21

Codons encoding each amino acid substitution

| Mutation | Codon | Mutation | Codon | Mutation | Codon | Mutation | Codon |
|---|---|---|---|---|---|---|---|
| F81C | TGT | T84L | TTG | N87S | AGT | W90H | CAT |
| F81E | GAG | T84D | GAT | N87I | ATT | W90M | ATG |
| F81I | ATT | T84R | CGG | N87C | TGT | W90R | CGG |

TABLE 21-continued

Codons encoding each amino acid substitution

| Mutation | Codon | Mutation | Codon | Mutation | Codon | Mutation | Codon |
|---|---|---|---|---|---|---|---|
| F81L | CTG | T84I | ATT | N87A | GCG | W90E | GAG |
| F81P | CCT | T84S | TCT | N87G | GGT | W90N | AAT |
| F81S | TCT | T84G | GGT | N87Y | TAT | W90Q | CAG |
| F81A | GCG | T84Q | CAG | N87E | GAG | E91N | AAT |
| F81M | ATG | T84P | CCT | N87H | CAT | E91R | CGG |
| F81G | GGG | T84A | GCG | N87Q | CAG | E91W | TGG |
| F81T | ACG | T84C | TGT | P88C | TGT | E91G | GGG |
| F81Q | CAG | T84Y | TAT | P88K | AAG | E91V | GTG |
| F81R | CGT | T84F | TTT | P88W | TGG | E91Y | TAT |
| F81W | TGG | E85L | CTG | P88G | GGG | E91C | TGT |
| F81H | CAT | E85Q | CAG | P88L | CTG | E91H | CAT |
| F81V | GTG | E85P | CCT | P88Q | CAG | E91T | ACG |
| V82I | ATT | E85T | ACT | P88A | GCG | E91S | AGT |
| V82C | TGT | E85K | AAG | P88T | ACG | E91A | GCG |
| V82A | GCG | E85M | ATG | P88Y | TAT | E91I | ATT |
| V82P | CCG | E85G | GGT | P88R | CGG | E91D | GAT |
| V82Y | TAT | E85R | CGT | P88H | CAT | E91F | TTT |
| V82M | ATG | E85S | TCT | P88I | ATT | E91L | TTG |
| V82Q | CAG | E85C | TGT | P88V | GTG | Q92V | GTT |
| V82F | TTT | E85Y | TAT | P88E | GAG | Q92Y | TAT |
| V82W | TGG | E85A | GCG | P88D | GAT | Q92L | CTG |
| V82N | AAT | E85N | AAT | R89V | GTG | Q92N | AAT |
| V82R | CGT | E85V | GTG | R89W | TGG | Q92E | GAG |
| V82G | GGT | E85F | TTT | R89M | ATG | Q92I | ATT |
| V82S | TCG | G86L | CTT | R89A | GCG | Q92T | ACT |
| V82L | TTG | G86P | CCG | R89T | ACG | Q92G | GGT |
| V82T | ACT | G86I | ATT | R89G | GGG | Q92P | CCG |
| L83A | GCG | G86T | ACT | R89S | TCT | Q92W | TGG |
| L83C | TGT | G86H | CAT | R89K | AAG | Q92F | TTT |
| L83D | GAT | G86D | GAT | R89F | TTT | Q92S | TCG |
| L83E | GAG | G86N | AAT | R89Y | TAT | Q92R | CGG |
| L83G | GGT | G86S | AGT | R89N | AAT | Q92K | AAG |
| L83H | CAT | G86K | AAG | R89H | CAT | Q92A | GCT |
| L83I | ATT | G86W | TGG | R89L | TTG | T93A | GCG |
| L83M | ATG | G86Y | TAT | R89E | GAG | T93L | CTT |
| L83P | CCG | G86V | GTT | R89P | CCT | T93M | ATG |
| L83Q | CAG | G86C | TGT | W90L | TTG | T93N | AAT |
| L83R | CGG | G86M | ATG | W90G | GGG | T93V | GTG |

TABLE 21-continued

Codons encoding each amino acid substitution

| Mutation | Codon | Mutation | Codon | Mutation | Codon | Mutation | Codon |
|---|---|---|---|---|---|---|---|
| L83S | AGT | G86F | TTT | W90P | CCG | T93I | ATT |
| L83T | ACG | N87M | ATG | W90T | ACT | T93D | GAT |
| L83W | TGG | N87L | CTG | W90S | TCG | T93S | TCG |
| L83Y | TAT | N87P | CCG | W90V | GTG | T93R | CGG |
| T84V | GTT | N87V | GTT | W90I | ATT | T93W | TGG |
| T84E | GAG | N87R | CGT | W90A | GCT | T93F | TTT |
| T84H | CAT | N87F | TTT | W90F | TTT | T93P | CCT |
| T93G | GGG | Y97R | CGT | E100L | CTG | T103R | CGG |
| T93K | AAG | Y97V | GTG | E100H | CAT | T103Y | TAT |
| T93E | GAG | Y97A | GCT | E100D | GAT | T103N | AAT |
| H94L | CTG | Y97P | CCT | E100M | ATG | T103C | TGT |
| H94S | TCG | Y97L | CTT | E100G | GGT | T103Q | CAG |
| H94M | ATG | Y97T | ACG | E100W | TGG | T103W | TGG |
| H94R | CGG | Y97K | AAG | E100Y | TAT | T103P | CCG |
| H94E | GAG | Y97W | TGG | E100R | CGT | T103A | GCG |
| H94I | ATT | Y97H | CAT | E100S | TCT | T103G | GGG |
| H94D | GAT | Y97S | TCG | E100T | ACG | T103K | AAG |
| H94P | CCG | Y97E | GAG | E100F | TTT | P104G | GGG |
| H94A | GCG | Y97D | GAT | E100I | ATT | P104E | GAG |
| H94N | AAT | Y97N | AAT | E100N | AAT | P104T | ACT |
| H94F | TTT | Y97G | GGT | N101M | ATG | P104F | TTT |
| H94G | GGG | Y97Q | CAG | N101F | TTT | P104R | CGT |
| H94T | ACT | R98H | CAT | N101L | TTG | P104D | GAT |
| H94V | GTG | R98K | AAG | N101V | GTG | P104C | TGT |
| H94W | TGG | R98C | TGT | N101H | CAT | P104Q | CAG |
| L95E | GAG | R98L | CTG | N101R | CGG | P104V | GTG |
| L95Y | TAT | R98M | ATG | N101C | TGT | P104Y | TAT |
| L95R | CGG | R98F | TTT | N101T | ACT | P104H | CAT |
| L95A | GCT | R98W | TGG | N101P | CCT | P104L | TTG |
| L95G | GGG | R98Y | TAT | N101W | TGG | P104S | TCG |
| L95K | AAG | R98P | CCT | N101K | AAG | P104A | GCG |
| L95S | AGT | R98E | GAG | N101S | TCG | P104M | ATG |
| L95T | ACG | R98A | GCG | N101D | GAT | D105A | GCT |
| L95H | CAT | R98G | GGG | N101A | GCG | D105C | TGT |
| L95W | TGG | R98V | GTT | N101Y | TAT | D105F | TTT |
| L95V | GTG | R98S | TCG | Y102R | CGT | D105G | GGT |
| L95C | TGT | R98D | GAT | Y102K | AAG | D105I | ATT |
| L95P | CCT | I99C | TGT | Y102V | GTG | D105L | CTG |

TABLE 21-continued

Codons encoding each amino acid substitution

| Mutation | Codon | Mutation | Codon | Mutation | Codon | Mutation | Codon |
|---|---|---|---|---|---|---|---|
| L95D | GAT | I99E | GAG | Y102M | ATG | D105M | ATG |
| L95I | ATT | I99G | GGG | Y102P | CCG | D105N | AAT |
| T96E | GAG | I99H | CAT | Y102N | AAT | D105P | CCT |
| T96R | CGG | I99N | AAT | Y102G | GGG | D105R | CGG |
| T96P | CCG | I99P | CCT | Y102L | CTG | D105S | TCG |
| T96S | TCG | I99T | ACG | Y102D | GAT | D105T | ACG |
| T96A | GCG | I99V | GTT | Y102S | TCG | D105V | GTT |
| T96L | TTG | I99A | GCG | Y102F | TTT | D105W | TGG |
| T96W | TGG | I99F | TTT | Y102A | GCT | D105E | GAG |
| T96N | AAT | I99L | CTG | Y102E | GAG | L106P | CCG |
| T96G | GGT | I99R | CGT | Y102Q | CAG | L106D | GAT |
| T96F | TTT | I99S | TCG | Y102C | TGT | L106N | AAT |
| T96Q | CAG | I99Q | CAG | T103E | GAG | L106G | GGT |
| T96H | CAT | I99W | TGG | T103D | GAT | L106M | ATG |
| T96V | GTT | I99Y | TAT | T103S | AGT | L106A | GCT |
| T96I | ATT | E100V | GTT | T103L | CTG | L106R | CGG |
| T96C | TGT | E100P | CCG | T103V | GTT | L106Y | TAT |
| L106T | ACG | A109V | GTT | D112I | ATT | E116A | GCG |
| L106V | GTG | A109E | GAG | D112Y | TAT | E116C | TGT |
| L106H | CAT | A109L | CTT | D112L | TTG | E116D | GAT |
| L106F | TTT | A109H | CAT | H113T | ACT | E116F | TTG |
| L106I | ATT | D110P | CCT | H113L | CTG | E116G | GGT |
| L106C | TGT | D110F | TTT | H113M | ATG | E116H | CAT |
| L106S | TCT | D110Q | CAG | H113S | TCG | E116I | ATT |
| P107L | TTG | D110R | CGG | H113N | AAT | E116K | AAG |
| P107W | TGG | D110M | ATG | H113R | AGG | E116L | CTG |
| P107T | ACT | D110H | CAT | H113A | GCT | E116M | ATG |
| P107S | TCG | D110I | ATT | H113E | GAG | E116N | AAT |
| P107R | CGG | D110L | CTT | H113V | GTG | E116P | CCG |
| P107Y | TAT | D110V | GTG | H113Y | TAT | E116Q | CAG |
| P107M | ATG | D110T | ACG | H113F | TTT | E116R | AGG |
| P107V | GTG | D110S | TCG | H113D | GAT | E116S | TCT |
| P107D | GAT | D110Y | TAT | H113W | TGG | K117H | CAT |
| P107A | GCG | D110G | GGT | H113G | GGG | K117T | ACG |
| P107C | TGT | D110C | TGT | H113P | CCG | K117Q | CAG |
| P107K | AAG | D110A | GCG | A114E | GAG | K117E | GAG |
| P107F | TTT | V111E | GAG | A114S | TCG | K117A | GCG |
| P107I | ATT | V111A | GCT | A114I | ATT | K117F | TTT |

TABLE 21-continued

Codons encoding each amino acid substitution

| Mutation | Codon | Mutation | Codon | Mutation | Codon | Mutation | Codon |
|---|---|---|---|---|---|---|---|
| P107G | GGT | V111S | TCT | A114P | CCT | K117D | GAT |
| R108P | CCT | V111W | TGG | A114N | AAT | K117N | AAT |
| R108G | GGT | V111G | GGT | A114L | CTT | K117G | GGT |
| R108T | ACG | V111Y | TAT | A114T | ACT | K117W | TGG |
| R108E | GAG | V111P | CCG | A114F | TTT | K117Y | TAT |
| R108A | GCG | V111L | CTG | A114V | GTT | K117L | TTG |
| R108Y | TAT | V111D | GAT | A114G | GGT | K117S | AGT |
| R108K | AAG | V111K | AAG | A114C | TGT | K117P | CCG |
| R108C | TGT | V111T | ACT | A114M | ATG | K117R | AGG |
| R108S | TCT | V111Q | CAG | A114R | AGG | A118G | GGG |
| R108F | TTT | V111I | ATT | A114W | TGG | A118R | CGT |
| R108W | TGG | V111C | TGT | A114Q | CAG | A118W | TGG |
| R108I | ATT | V111R | CGT | I115F | TTT | A118K | AAG |
| R108L | CTT | D112A | GCG | I115T | ACT | A118P | CCT |
| R108N | AAT | D112M | ATG | I115H | CAT | A118V | GTG |
| R108V | GTT | D112V | GTT | I115G | GGT | A118L | TTG |
| A109S | TCG | D112R | CGG | I115K | AAG | A118D | GAT |
| A109R | CGG | D112K | AAG | I115E | GAG | A118S | AGT |
| A109T | ACG | D112P | CCT | I115S | AGT | A118F | TTT |
| A109W | TGG | D112Q | CAG | I115P | CCT | A118I | ATT |
| A109I | ATT | D112F | TTT | I115C | TGT | A118H | CAT |
| A109Q | CAG | D112G | GGG | I115L | CTT | A118E | GAG |
| A109N | AAT | D112C | TGT | I115Q | CAG | A118Q | CAG |
| A109Y | TAT | D112W | TGG | I115R | CGG | A118T | ACT |
| A109G | GGG | D112T | ACT | I115W | TGG | F119G | GGG |
| A109M | ATG | D112H | CAT | I115V | GTT | F119T | ACT |
| A109D | GAT | D112S | TCT | I115D | GAT | F119R | CGG |
| F119L | TTG | W122G | GGG | V125T | ACG | L128A | GCG |
| F119N | AAT | W122S | TCG | V125A | GCT | L128D | GAT |
| F119S | AGT | W122V | GTT | V125C | TGT | L128V | GTG |
| F119C | TGT | W122H | CAT | V125D | GAT | L128W | TGG |
| F119P | CCG | W122F | TTT | V125W | TGG | L128C | TGT |
| F119W | TGG | W122Y | TAT | V125R | CGG | L128K | AAG |
| F119K | AAG | W122K | AAG | V125E | GAA | T129G | GGT |
| F119H | CAT | W122Q | CAG | V125F | TTT | T129A | GCT |
| F119A | GCG | W122E | GAG | V125H | CAT | T129C | TGT |
| F119V | GTT | S123D | GAT | T126K | AAG | T129K | AAG |
| F119Y | TAT | S123L | TTG | T126V | GTG | T129F | TTT |

TABLE 21-continued

Codons encoding each amino acid substitution

| Mutation | Codon | Mutation | Codon | Mutation | Codon | Mutation | Codon |
|---|---|---|---|---|---|---|---|
| F119E | GAG | S123A | GCT | T126G | GGG | T129Y | TAT |
| Q120K | AAG | S123C | TGT | T126R | CGG | T129S | TCG |
| Q120N | AAT | S123I | ATT | T126L | TTG | T129R | CGG |
| Q120A | GCG | S123K | AAG | T126H | CAT | T129V | GTT |
| Q120V | GTG | S123N | AAT | T126M | ATG | T129L | CTT |
| Q120D | GAT | S123F | TTT | T126P | CCG | T129H | CAT |
| Q120R | CGG | S123Y | TAT | T126A | GCG | T129P | CCT |
| Q120P | CCT | S123M | ATG | T126N | AAT | T129E | GAG |
| Q120W | TGG | S123H | CAT | T126E | GAG | T129I | ATT |
| Q120Y | TAT | S123R | CGG | T126F | TTT | T129M | ATG |
| Q120C | TGT | S123W | TGG | T126W | TGG | F130L | CTG |
| Q120H | CAT | S123T | ACG | T126Q | CAG | F130P | CCT |
| Q120T | ACT | S123P | CCT | T126S | AGT | F130C | TGT |
| Q120M | ATG | S123G | GGG | P127C | TGT | F130R | CGG |
| Q120E | GAG | S123Q | CAG | P127F | TTT | F130Y | TAT |
| Q120G | GGT | S123V | GTT | P127T | ACG | F130H | CAT |
| L121E | GAG | N124G | GGT | P127E | GAG | F130I | ATT |
| L121Q | CAG | N124C | TGT | P127W | TGG | F130V | GTT |
| L121P | CCT | N124V | GTG | P127A | GCT | F130K | AAG |
| L121R | CGG | N124L | CTT | P127S | AGT | F130T | ACT |
| L121C | TGT | N124T | ACG | P127H | CAT | F130E | GAG |
| L121G | GGG | N124R | CGT | P127Q | CAG | F130A | GCG |
| L121K | AAG | N124M | ATG | P127K | AAG | F130N | AAT |
| L121F | TTT | N124S | TCG | P127R | CGG | F130G | GGT |
| L121I | ATT | N124P | CCT | P127I | ATT | F130S | AGT |
| L121S | TCG | N124A | GCG | P127V | GTG | T131F | TTT |
| L121V | GTT | N124K | AAG | P127L | CTG | T131P | CCG |
| L121H | CAT | N124F | TTT | P127M | ATG | T131A | GCG |
| L121T | ACT | N124W | TGG | L128F | TTT | T131S | TCT |
| L121A | GCT | N124I | ATT | L128M | ATG | T131G | GGT |
| L121N | AAT | N124D | GAT | L128T | ACT | T131I | ATT |
| W122R | CGT | V125G | GGG | L128R | CGT | T131L | CTT |
| W122A | GCG | V125Q | CAG | L128S | TCG | T131H | CAT |
| W122N | AAT | V125S | TCG | L128G | GGT | T131Q | CAG |
| W122P | CCG | V125P | CCG | L128I | ATT | T131D | GAT |
| W122T | ACG | V125M | ATG | L128Q | CAG | T131E | GAG |
| W122L | CTT | V125Y | TAT | L128P | CCT | T131C | TGT |
| T131R | CGT | E135V | GTT | A138C | TGT | M141S | AGT |

TABLE 21-continued

Codons encoding each amino acid substitution

| Mutation | Codon | Mutation | Codon | Mutation | Codon | Mutation | Codon |
|---|---|---|---|---|---|---|---|
| T131Y | TAT | E135M | ATG | A138T | ACG | M141C | TGT |
| T131M | ATG | E135S | TCG | A138S | TCT | M141L | CTG |
| K132G | GGT | E135D | GAT | A138R | CGT | M141A | GCG |
| K132V | GTG | E135T | ACG | A138G | GGG | M141D | GAT |
| K132L | TTG | E135L | CTG | A138E | GAG | M141W | TGG |
| K132A | GCT | E135A | GCG | A138H | CAT | M141G | GGT |
| K132P | CCG | E135W | TGG | A138M | ATG | M141H | CAT |
| K132F | TTT | E135F | TTT | A138Q | CAG | M141Y | TAT |
| K132R | CGG | E135P | CCG | A138I | ATT | M141N | AAT |
| K132I | ATT | E135R | CGG | A138D | GAT | I142L | CTG |
| K132H | CAT | E135N | AAT | A138W | TGG | I142M | ATG |
| K132S | TCT | E135H | CAT | D139R | CGT | I142G | GGT |
| K132M | ATG | E135Q | CAG | D139V | GTT | I142K | AAG |
| K132D | GAT | E135I | ATT | D139M | ATG | I142A | GCT |
| K132T | ACT | G136V | GTG | D139C | TGT | I142N | AAT |
| K132Y | TAT | G136W | TGG | D139P | CCT | I142W | TGG |
| K132E | GAG | G136D | GAT | D139S | TCT | I142P | CCG |
| V133G | GGG | G136M | ATG | D139L | CTT | I142Q | CAG |
| V133E | GAG | G136N | AAT | D139I | ATT | I142Y | TAT |
| V133T | ACT | G136A | GCG | D139H | CAT | I142V | GTG |
| V133N | AAT | G136L | TTG | D139A | GCG | I142T | ACT |
| V133A | GCG | G136C | TGT | D139G | GGG | I142R | CGG |
| V133H | CAT | G136P | CCG | D139F | TTT | I142S | AGT |
| V133P | CCG | G136T | ACG | D139N | AAT | I142F | TTT |
| V133K | AAG | G136R | CGT | D139W | TGG | S143P | CCG |
| V133R | CGG | G136S | TCG | D139Y | TAT | S143C | TGT |
| V133L | CTT | G136I | ATT | D139E | GAG | S143E | GAG |
| V133W | TGG | G136H | CAT | I140D | GAT | S143G | GGT |
| V133C | TGT | G136E | GAG | I140K | AAG | S143H | CAT |
| V133D | GAT | Q137A | GCT | I140A | GCT | S143R | CGT |
| V133M | ATG | Q137R | CGG | I140G | GGG | S143L | TTG |
| V133S | AGT | Q137G | GGG | I140C | TGT | S143Q | CAG |
| S134V | GTT | Q137K | AAG | I140Y | TAT | S143N | AAT |
| S134H | CAT | Q137H | CAT | I140V | GTT | S143W | TGG |
| S134P | CCT | Q137P | CCT | I140W | TGG | S143A | GCT |
| S134G | GGG | Q137S | TCG | I140F | TTT | S143T | ACT |
| S134N | AAT | Q137L | CTG | I140H | CAT | S143Y | TAT |
| S134R | CGT | Q137W | TGG | I140L | CTG | S143M | ATG |

TABLE 21-continued

Codons encoding each amino acid substitution

| Mutation | Codon | Mutation | Codon | Mutation | Codon | Mutation | Codon |
|---|---|---|---|---|---|---|---|
| S134L | CTG | Q137F | TTT | I140R | CGG | S143I | ATT |
| S134Q | CAG | Q137T | ACG | I140E | GAG | F144K | AAG |
| S134E | GAG | Q137C | TGT | I140M | ATG | F144M | ATG |
| S134Y | TAT | Q137Y | TAT | I140T | ACT | F144E | GAG |
| S134A | GCG | Q137N | AAT | M141E | GAG | F144S | AGT |
| S134K | AAG | Q137E | GAG | M141I | ATT | F144L | CTG |
| S134D | GAT | A138V | GTT | M141R | CGG | F144W | TGG |
| S134T | ACG | A138L | CTT | M141T | ACG | F144P | CCG |
| S134C | TGT | A138P | CCG | M141P | CCG | F144R | CGG |
| F144N | AAT | G147V | GTT | R150H | CAT | P154L | CTT |
| F144C | TGT | G147Q | CAG | D151R | CGT | P154C | TGT |
| F144G | GGT | G147M | ATG | D151F | TTT | P154S | TCT |
| F144T | ACT | G147P | CCT | D151P | CCG | P154K | AAG |
| F144Q | CAG | D148R | CGG | D151W | TGG | P154I | ATT |
| F144H | CAT | D148I | ATT | D151Q | CAG | P154A | GCT |
| F144V | GTG | D148T | ACG | D151L | CTT | P154T | ACG |
| V145A | GCG | D148G | GGT | D151S | TCG | P154H | CAT |
| V145T | ACG | D148L | CTG | D151G | GGT | P154Y | TAT |
| V145L | CTG | D148V | GTT | D151A | GCT | P154N | AAT |
| V145P | CCG | D148A | GCG | D151N | AAT | P154F | TTT |
| V145K | AAG | D148W | TGG | D151K | AAG | P154R | CGT |
| V145N | AAT | D148P | CCG | D151Y | TAT | P154Q | CAG |
| V145D | GAT | D148S | TCG | D151V | GTT | F155S | TCT |
| V145H | CAT | D148K | AAG | D151T | ACT | F155T | ACT |
| V145R | CGG | D148E | GAG | D151M | ATG | F155G | GGT |
| V145Q | CAG | D148M | ATG | N152G | GGG | F155N | AAT |
| V145S | TCT | D148N | AAT | N152C | TGT | F155R | CGG |
| V145G | GGG | D148C | TGT | N152F | TTT | F155W | TGG |
| V145W | TGG | H149W | TGG | N152L | TTG | F155L | CTG |
| V145C | TGT | H149A | GCG | N152P | CCG | F155Q | CAG |
| V145E | GAG | H149L | TTG | N152R | CGG | F155M | ATG |
| R146T | ACG | H149C | TGT | N152H | CAT | F155E | GAG |
| R146L | CTG | H149Q | CAG | N152T | ACG | F155A | GCG |
| R146N | AAT | H149T | ACT | N152Y | TAT | F155P | CCT |
| R146H | CAT | H149Y | TAT | N152K | AAG | F155V | GTT |
| R146Q | CAG | H149P | CCG | N152D | GAT | F155H | CAT |
| R146K | AAG | H149V | GTT | N152W | TGG | F155Y | TAT |
| R146C | TGT | H149R | CGG | N152I | ATT | D156H | CAT |

TABLE 21-continued

Codons encoding each amino acid substitution

| Mutation | Codon | Mutation | Codon | Mutation | Codon | Mutation | Codon |
|---|---|---|---|---|---|---|---|
| R146S | AGT | H149G | GGT | N152A | GCG | D156L | CTT |
| R146D | GAT | H149E | GAG | N152S | TCT | D156E | GAG |
| R146A | GCT | H149S | AGT | S153I | ATT | D156A | GCT |
| R146Y | TAT | H149I | ATT | S153R | CGG | D156W | TGG |
| R146P | CCT | H149N | AAT | S153K | AAG | D156C | TGT |
| R146V | GTT | R150S | TCG | S153C | TGT | D156P | CCT |
| R146E | GAG | R150E | GAG | S153G | GGG | D156V | GTT |
| R146F | TTT | R150G | GGG | S153H | CAT | D156K | AAG |
| G147R | CGT | R150M | ATG | S153L | CTT | D156S | TCT |
| G147F | TTT | R150P | CCG | S153V | GTT | D156G | GGG |
| G147I | ATT | R150T | ACG | S153T | ACG | D156T | ACT |
| G147L | CTG | R150W | TGG | S153P | CCT | D156Y | TAT |
| G147A | GCG | R150A | GCG | S153A | GCG | D156R | CGT |
| G147E | GAG | R150N | AAT | S153F | TTT | D156M | ATG |
| G147H | CAT | R150K | AAG | S153D | GAT | G157K | AAG |
| G147W | TGG | R150L | TTG | S153Q | CAG | G157D | GAT |
| G147T | ACG | R150V | GTT | S153Y | TAT | G157F | TTT |
| G147C | TGT | R150D | GAT | P154V | GTT | G157R | CGT |
| G147S | TCT | R150I | ATT | P154W | TGG | G157H | CAT |
| G157L | TTG | G160M | ATG | A163E | GAG | F166C | TGT |
| G157N | AAT | G160C | TGT | A163T | ACG | F166E | GAG |
| G157Y | TAT | G160Q | CAG | A163Q | CAG | Q167D | GAT |
| G157S | TCG | G160V | GTT | A163I | ATT | Q167R | CGG |
| G157T | ACG | G160S | AGT | A163N | AAT | Q167A | GCG |
| G157A | GCT | G160E | GAG | H164L | CTT | Q167S | AGT |
| G157Q | CAG | G160L | CTT | H164M | ATG | Q167F | TTT |
| G157P | CCG | G160T | ACG | H164K | AAG | Q167Y | TAT |
| G157V | GTG | N161S | AGT | H164P | CCG | Q167P | CCG |
| G157M | ATG | N161C | TGT | H164C | TGT | Q167T | ACT |
| P158S | TCT | N161L | TTG | H164R | CGT | Q167V | GTG |
| P158Y | TAT | N161R | CGT | H164A | GCG | Q167L | CTG |
| P158R | CGG | N161G | GGT | H164V | GTG | Q167M | ATG |
| P158L | CTT | N161W | TGG | H164S | TCG | Q167N | AAT |
| P158V | GTG | N161Y | TAT | H164N | AAT | Q167G | GGG |
| P158C | TGT | N161E | GAG | H164G | GGG | Q167K | AAG |
| P158A | GCG | N161P | CCT | H164F | TTT | Q167E | GAG |
| P158W | TGG | N161T | ACG | H164Y | TAT | P168N | AAT |
| P158I | ATT | N161H | CAT | H164Q | CAG | P168F | TTT |

TABLE 21-continued

Codons encoding each amino acid substitution

| Mutation | Codon | Mutation | Codon | Mutation | Codon | Mutation | Codon |
|---|---|---|---|---|---|---|---|
| P158F | TTT | N161I | ATT | H164E | GAG | P168R | CGG |
| P158Q | CAG | N161V | GTG | A165W | TGG | P168W | TGG |
| P158T | ACT | N161F | TTT | A165V | GTT | P168A | GCT |
| P158G | GGT | N161Q | CAG | A165G | GGG | P168T | ACG |
| P158K | AAG | L162A | GCT | A165K | AAG | P168V | GTT |
| P158N | AAT | L162G | GGG | A165L | TTG | P168G | GGG |
| P158D | GAT | L162C | TGT | A165P | CCT | P168C | TGT |
| G159R | CGG | L162P | CCG | A165Q | CAG | P168M | ATG |
| G159S | AGT | L162R | CGG | A165D | GAT | P168H | CAT |
| G159Q | CAG | L162I | ATT | A165H | CAT | P168L | CTT |
| G159P | CCT | L162S | TCT | A165F | TTT | P168S | AGT |
| G159V | GTG | L162D | GAT | A165S | AGT | P168I | ATT |
| G159K | AAG | L162M | ATG | A165T | ACT | P168D | GAT |
| G159A | GCG | L162E | GAG | A165R | CGG | G169H | CAT |
| G159Y | TAT | L162T | ACT | A165N | AAT | G169A | GCG |
| G159E | GAG | L162Y | TAT | A165M | ATG | G169E | GAG |
| G159T | ACG | L162F | TTT | F166G | GGG | G169C | TGT |
| G159M | ATG | L162W | TGG | F166S | TCG | G169S | TCG |
| G159I | ATT | L162Q | CAG | F166L | CTT | G169L | CTG |
| G159W | TGG | A163R | CGT | F166V | GTG | G169V | GTT |
| G159L | CTG | A163G | GGG | F166P | CCT | G169T | ACG |
| G159C | TGT | A163Y | TAT | F166N | AAT | G169R | CGG |
| G160A | GCG | A163P | CCT | F166R | CGT | G169W | TGG |
| G160H | CAT | A163S | AGT | F166A | GCG | G169M | ATG |
| G160N | AAT | A163L | CTT | F166K | AAG | G169I | ATT |
| G160W | TGG | A163C | TGT | F166H | CAT | G169P | CCG |
| G160R | CGG | A163K | AAG | F166W | TGG | G169D | GAT |
| G160P | CCG | A163V | GTG | F166I | ATT | G169Q | CAG |
| G160I | ATT | A163F | TTT | F166M | ATG | P170L | CTT |
| P170R | CGG | G173S | AGT | A176L | CTG | D179I | ATT |
| P170I | ATT | G173A | GCG | A176P | CCT | D179R | CGT |
| P170T | ACG | G173R | AGG | A176N | AAT | D179N | AAT |
| P170F | TTT | G173N | AAT | A176G | GGT | D179W | TGG |
| P170Q | CAG | G173T | ACG | A176S | TCT | D179Q | CAG |
| P170G | GGG | G173D | GAT | A176R | CGT | D179V | GTG |
| P170S | TCT | G173V | GTT | A176K | AAG | D179C | TGT |
| P170H | CAT | G173F | TTT | A176D | GAT | E180M | ATG |
| P170C | TGT | G173M | ATG | A176W | TGG | E180P | CCT |

TABLE 21-continued

Codons encoding each amino acid substitution

| Mutation | Codon | Mutation | Codon | Mutation | Codon | Mutation | Codon |
|---|---|---|---|---|---|---|---|
| P170M | ATG | G173Y | TAT | H177T | ACG | E180K | AAG |
| P170K | AAG | G173P | CCG | H177P | CCG | E180Y | TAT |
| P170W | TGG | G174R | CGT | H177Q | CAG | E180Q | CAG |
| P170D | GAT | G174A | GCG | H177A | GCG | E180R | CGG |
| P170A | GCG | G174E | GAG | H177S | TCG | E180A | GCG |
| G171S | TCT | G174F | TTT | H177G | GGG | E180T | ACT |
| G171M | ATG | G174H | CAT | H177W | TGG | E180I | ATT |
| G171N | AAT | G174T | ACT | H177L | CTG | E180F | TTT |
| G171P | CCT | G174D | GAT | H177V | GTT | E180C | TGT |
| G171R | CGG | G174S | AGT | H177I | ATT | E180G | GGG |
| G171Y | TAT | G174P | CCG | H177R | CGG | E180S | TCG |
| G171A | GCT | G174W | TGG | H177N | AAT | E180N | AAT |
| G171Q | CAG | G174V | GTT | H177Y | TAT | E180D | GAT |
| G171H | CAT | G174N | AAT | H177C | TGT | D181S | TCG |
| G171L | CTT | G174Y | TAT | H177D | GAT | D181Q | CAG |
| G171W | TGG | G174M | ATG | F178G | GGT | D181P | CCT |
| G171C | TGT | G174L | CTT | F178C | TGT | D181Y | TAT |
| G171K | AAG | D175I | ATT | F178W | TGG | D181R | CGT |
| G171E | GAG | D175T | ACG | F178R | CGG | D181V | GTT |
| G171D | GAT | D175N | AAT | F178K | AAG | D181F | TTT |
| I172Y | TAT | D175V | GTT | F178S | AGT | D181A | GCT |
| I172T | ACG | D175S | TCG | F178H | CAT | D181T | ACG |
| I172P | CCT | D175R | CGG | F178P | CCT | D181L | TTG |
| I172A | GCG | D175G | GGG | F178V | GTT | D181E | GAG |
| I172L | CTT | D17SA | GCG | F178A | GCT | D181K | AAG |
| I172Q | CAG | D175F | TTT | F178Q | CAG | D181M | ATG |
| I172E | GAG | D175C | TGT | F178Y | TAT | D181C | TGT |
| I172C | TGT | D175Q | CAG | F178I | ATT | D181G | GGT |
| I172M | ATG | D175Y | TAT | F178T | ACT | E182C | TGT |
| I172D | GAT | D175L | CTG | F178L | CTG | E182P | CCT |
| I172V | GTT | D175H | CAT | F178E | GAG | E182S | AGT |
| I172R | CGT | D175P | CCG | D179P | CCT | E182T | ACG |
| I172G | GGG | D175E | GAG | D179L | TTG | E182R | CGG |
| I172W | TGG | A176F | TTT | D179E | GAG | E182D | GAT |
| I172N | AAT | A176Q | CAG | D179G | GGG | E182A | GCT |
| G173C | TGT | A176V | GTG | D179S | AGT | E182F | TTT |
| G173L | CTG | A176E | GAG | D179A | GCT | E182L | CTT |
| G173K | AAG | A176T | ACT | D179K | AAG | E182I | ATT |

TABLE 21-continued

Codons encoding each amino acid substitution

| Mutation | Codon | Mutation | Codon | Mutation | Codon | Mutation | Codon |
|---|---|---|---|---|---|---|---|
| G173W | TGG | A176C | TGT | D179T | ACT | E182Y | TAT |
| E182Q | CAG | T185D | GAT | R189K | AAG | N192S | TCG |
| E182W | TGG | N186G | GGG | R189P | CCG | N192W | TGG |
| E182M | ATG | N186A | GCT | R189E | GAG | N192G | GGG |
| E182G | GGT | N186T | ACT | R189V | GTT | N192D | GAT |
| R183P | CCT | N186R | CGT | R189D | GAT | N192V | GTG |
| R183K | AAG | N186L | TTG | R189Y | TAT | N192A | GCT |
| R183W | TGG | N186P | CCG | R189C | TGT | N192T | ACT |
| R183E | GAG | N186S | AGT | R189A | GCT | N192K | AAG |
| R183A | GCT | N186V | GTG | R189H | CAT | N192C | TGT |
| R183T | ACG | N186Q | CAG | R189W | TGG | N192M | ATG |
| R183L | CTT | N186H | CAT | R189N | AAT | L193P | CCG |
| R183N | AAT | N186C | TGT | R189T | ACT | L193G | GGG |
| R183H | CAT | N186E | GAG | R189Q | CAG | L193F | TTT |
| R183V | GTG | N186F | TTT | E190A | GCG | L193S | TCG |
| R183C | TGT | N186Y | TAT | E190H | CAT | L193W | TGG |
| R183M | ATG | N186D | GAT | E190V | GTG | L193A | GCT |
| R183I | ATT | N187R | CGG | E190P | CCG | L193R | CGT |
| R183G | GGT | N187M | ATG | E190C | TGT | L193Q | CAG |
| R183S | TCT | N187S | TCT | E190G | GGT | L193E | GAG |
| W184G | GGG | N187T | ACG | E190R | CGG | L193K | AAG |
| W184H | CAT | N187L | CTG | E190I | ATT | L193N | AAT |
| W184L | CTG | N187W | TGG | E190S | TCG | L193I | ATT |
| W184E | GAG | N187F | TTT | E190T | ACT | L193T | ACT |
| W184P | CCT | N187K | AAG | E190M | ATG | L193D | GAT |
| W184N | AAT | N187I | ATT | E190L | TTG | L193Y | TAT |
| W184A | GCG | N187A | GCT | E190K | AAG | H194S | AGT |
| W184T | ACT | N187P | CCG | E190Y | TAT | H194E | GAG |
| W184R | CGG | N187D | GAT | E190D | GAT | H194K | AAG |
| W184Q | CAG | N187G | GGG | Y191T | ACT | H194Q | CAG |
| W184V | GTG | N187C | TGT | Y191H | CAT | H194V | GTT |
| W184S | TCT | N187H | CAT | Y191G | GGG | H194T | ACT |
| W184M | ATG | F188P | CCG | Y191L | TTG | H194L | CTG |
| W184I | ATT | F188I | ATT | Y191P | CCT | H194Y | TAT |
| W184F | TTT | F188N | AAT | Y191Q | CAG | H194F | TTT |
| T185R | CGT | F188S | AGT | Y191K | AAG | H194G | GGT |
| T185Y | TAT | F188Q | CAG | Y191D | GAT | H194I | ATT |
| T185W | TGG | F188K | AAG | Y191A | GCG | H194W | TGG |

TABLE 21-continued

Codons encoding each amino acid substitution

| Mutation | Codon | Mutation | Codon | Mutation | Codon | Mutation | Codon |
|---|---|---|---|---|---|---|---|
| T185H | CAT | F188G | GGG | Y191W | TGG | H194M | ATG |
| T185G | GGG | F188W | TGG | Y191S | TCT | H194A | GCT |
| T185P | CCT | F188E | GAG | Y191V | GTT | H194P | CCT |
| T185S | TCG | F188H | CAT | Y191E | GAG | R195C | TGT |
| T185V | GTT | F188D | GAT | Y191R | CGT | R195F | TTT |
| T185Q | CAG | F188A | GCG | Y191C | TGT | R195W | TGG |
| T185N | AAT | F188L | CTT | N192R | CGG | R195T | ACT |
| T185C | TGT | F188R | CGT | N192L | CTG | R195L | CTG |
| T185L | CTT | F188V | GTT | N192Q | CAG | R195G | GGT |
| T185A | GCG | R189L | TTG | N192P | CCT | R195Q | CAG |
| T185E | GAG | R189G | GGG | N192H | CAT | R195K | AAG |
| R195S | TCT | A198F | TTT | L201N | AAT | L205S | TCT |
| R195A | GCT | A198W | TGG | G202T | ACG | L205G | GGT |
| R195D | GAT | A198Y | TAT | G202Y | TAT | L205P | CCT |
| R195P | CCT | A198D | GAT | G202E | GAG | L205E | GAG |
| R195Y | TAT | H199I | ATT | G202V | GTG | L205V | GTG |
| R195E | GAG | H199P | CCG | G202S | TCT | L205M | ATG |
| R195V | GTG | H199G | GGT | G202L | CTG | L205N | AAT |
| V196T | ACG | H199N | AAT | G202I | ATT | L205C | TGT |
| V196D | GAT | H199S | TCG | G202M | ATG | L205I | ATT |
| V196G | GGG | H199L | TTG | G202H | CAT | L205A | GCG |
| V196E | GAG | H199M | ATG | G202C | TGT | L205R | CGG |
| V196A | GCG | H199A | GCG | G202R | CGT | L205W | TGG |
| V196S | AGT | H199C | TGT | G202P | CCT | L205Q | CAG |
| V196Q | CAG | H199K | AAG | G202A | GCT | G206I | ATT |
| V196P | CCG | H199R | CGT | G202K | AAG | G206V | GTG |
| V196R | CGT | H199V | GTG | G202D | GAT | G206A | GCG |
| V196H | CAT | H199W | TGG | H203Y | TAT | G206C | TGT |
| V196Y | TAT | H199T | ACT | H203E | GAG | G206S | TCG |
| V196I | ATT | H199E | GAG | H203R | CGG | G206P | CCG |
| V196L | CTG | E200P | CCG | H203Q | CAG | G206L | TTG |
| V196K | AAG | E200G | GGG | H203P | CCG | G206D | GAT |
| V196M | ATG | E200A | GCT | H203G | GGG | G206M | ATG |
| A197G | GGT | E200T | ACG | H203T | ACT | G206R | CGG |
| A197S | AGT | E200I | ATT | H203D | GAT | G206Q | CAG |
| A197L | CTT | E200W | TGG | H203L | TTG | G206E | GAG |
| A197P | CCG | E200R | CGG | H203N | AAT | G206H | CAT |
| A197V | GTG | E200F | TTT | H203A | GCT | G206T | ACG |

TABLE 21-continued

Codons encoding each amino acid substitution

| Mutation | Codon | Mutation | Codon | Mutation | Codon | Mutation | Codon |
|---|---|---|---|---|---|---|---|
| A197Y | TAT | E200M | ATG | H203S | TCT | G206W | TGG |
| A197Q | CAG | E200D | GAT | H203V | GTT | L207S | TCT |
| A197R | CGG | E200V | GTG | H203I | ATT | L207Y | TAT |
| A197T | ACT | E200C | TGT | H203C | TGT | L207A | GCG |
| A197I | ATT | E200S | TCT | S204R | CGG | L207R | CGT |
| A197H | CAT | E200Y | TAT | S204N | AAT | L207P | CCG |
| A197E | GAG | E200N | AAT | S204A | GCG | L207Q | CAG |
| A197W | TGG | L201A | GCG | S204T | ACT | L207N | AAT |
| A197N | AAT | L201R | CGG | S204Y | TAT | L207K | AAG |
| A197C | TGT | L201E | GAG | S204V | GTG | L207M | ATG |
| A198T | ACG | L201P | CCT | S204L | CTT | L207W | TGG |
| A198K | AAG | L201G | GGT | S204H | CAT | L207H | CAT |
| A198S | TCG | L201V | GTT | S204D | GAT | L207D | GAT |
| A198H | CAT | L201T | ACG | S204Q | CAG | L207V | GTT |
| A198G | GGT | L201I | ATT | S204G | GGG | L207I | ATT |
| A198E | GAG | L201S | TCT | S204W | TGG | L207G | GGT |
| A198P | CCG | L201W | TGG | S204I | ATT | S208D | GAT |
| A198L | TTG | L201Q | CAG | S204K | AAG | S208V | GTT |
| A198R | CGT | L201D | GAT | S204P | CCT | S208P | CCT |
| A198V | GTT | L201M | ATG | L205T | ACG | S208G | GGT |
| A198M | ATG | L201K | AAG | L205D | GAT | S208A | GCG |
| S208K | AAG | T211Q | CAG | G214A | GCT | M217A | GCG |
| S208N | AAT | T211S | TCG | G214D | GAT | M217H | CAT |
| S208F | TTT | T211A | GCG | G214F | TTT | M217I | ATT |
| S208Q | CAG | T211F | TTT | G214Y | TAT | M217D | GAT |
| S208W | TGG | T211D | GAT | G214M | ATG | Y218C | TGT |
| S208T | ACG | T211W | TGG | G214C | TGT | Y218F | TTT |
| S208E | GAG | T211L | CTG | A215L | CTG | Y218W | TGG |
| S208C | TGT | D212E | GAG | A215Q | CAG | Y218L | CTG |
| S208R | CGT | D212A | GCG | A215M | ATG | Y218A | GCG |
| S208L | CTT | D212K | AAG | A215G | GGT | Y218P | CCG |
| H209T | ACG | D212R | CGG | A215W | TGG | Y218R | CGG |
| H209Y | TAT | D212T | ACG | A215S | AGT | Y218N | AAT |
| H209R | CGG | D212N | AAT | A215T | ACG | Y218V | GTG |
| H209Q | CAG | D212G | GGG | A215V | GTT | Y218Q | CAG |
| H209A | GCT | D212S | TCT | A215N | AAT | Y218I | ATT |
| H209G | GGG | D212P | CCG | A215P | CCG | Y218D | GAT |
| H209N | AAT | D212Q | CAG | A215H | CAT |

TABLE 21-continued

Codons encoding each amino acid substitution

| Mutation | Codon | Mutation | Codon | Mutation | Codon | Mutation | Codon |
|---|---|---|---|---|---|---|---|
| H209P | CCT | D212V | GTT | A215K | AAG | Y218G | GGG |
| H209W | TGG | D212L | TTG | A215I | ATT | Y218E | GAG |
| H209V | GTT | D212F | TTT | A215R | CGT | P219L | TTG |
| H209D | GAT | D212H | CAT | A215C | TGT | P219C | TGT |
| H209S | AGT | D212Y | TAT | A215D | GAT | P219V | GTG |
| H209F | TTT | I213Q | CAG | L216A | GCT | P219D | GAT |
| H209L | CTG | I213T | ACT | L216C | TGT | P219F | TTT |
| H209C | TGT | I213C | TGT | L216D | GAT | P219A | GCG |
| S210C | TGT | I213P | CCT | L216E | GAG | P219T | ACT |
| S210G | GGT | I213H | CAT | L216G | GGG | P219E | GAG |
| S210I | ATT | I213A | GCG | L216I | ATT | P219Q | CAG |
| S210R | CGT | I213V | GTT | L216K | AAG | P219R | CGG |
| S210L | CTG | I213G | GGG | L216M | ATG | P219H | CAT |
| S210V | GTG | I213N | AAT | L216P | CCT | P219G | GGG |
| S210H | CAT | I213L | CTT | L216Q | CAG | P219K | AAG |
| S210N | AAT | I213S | AGT | L216R | CGG | P219S | TCG |
| S210F | TTT | I213M | ATG | L216S | TCT | P219W | TGG |
| S210P | CCG | I213R | CGG | L216T | ACT | S220R | CGT |
| S210W | TGG | I213K | AAG | L216V | GTG | S220A | GCG |
| S210Q | CAG | I213F | TTT | L216W | TGG | S220Q | CAG |
| S210T | ACG | I213D | GAT | M217P | CCT | S220T | ACT |
| S210K | AAG | I213E | GAG | M217Y | TAT | S220L | CTT |
| S210A | GCG | G214L | TTG | M217T | ACG | S220K | AAG |
| T211P | CCG | G214Q | CAG | M217C | TGT | S220G | GGG |
| T211R | CGT | G214S | TCT | M217S | AGT | S220H | CAT |
| T211K | AAG | G214T | ACT | M217L | CTG | S220E | GAG |
| T211G | GGG | G214V | GTG | M217N | AAT | S220M | ATG |
| T211M | ATG | G214I | ATT | M217R | CGG | S220V | GTT |
| T211N | AAT | G214R | CGT | M217Q | CAG | S220P | CCG |
| T211V | GTG | G214P | CCG | M217K | AAG | S220I | ATT |
| T211H | CAT | G214E | GAG | M217G | GGG | S220F | TTT |
| S220N | AAT | S224T | ACG | V227K | AAG | A230S | TCG |
| Y221W | TGG | S224Q | CAG | V227L | CTG | A230C | TGT |
| Y221K | AAG | S224R | CGG | V227P | CCT | A230V | GTT |
| Y221Q | CAG | S224P | CCG | V227S | TCT | A230T | ACT |
| Y221C | TGT | S224I | ATT | V227T | ACT | A230Y | TAT |
| Y221N | AAT | S224V | GTT | V227W | TGG | A230M | ATG |
| Y221P | CCT | S224L | TTG | V227Y | TAT | A230N | AAT |

TABLE 21-continued

| Codons encoding each amino acid substitution | | | | | | | |
|---|---|---|---|---|---|---|---|
| Mutation | Codon | Mutation | Codon | Mutation | Codon | Mutation | Codon |
| Y221V | GTT | S224C | TGT | V227G | GGG | A230H | CAT |
| Y221A | GCG | S224K | AAG | V227H | CAT | Q231I | ATT |
| Y221G | GGG | S224D | GAT | V227Q | CAG | Q231A | GCT |
| Y221R | CGG | S224H | CAT | V227R | CGT | Q231F | TTT |
| Y221S | TCG | S224M | ATG | Q228A | GCT | Q231P | CCT |
| Y221M | ATG | S224A | GCT | Q228D | GAT | Q231Y | TAT |
| Y221T | ACG | S224W | TGG | Q228E | GAG | Q231R | CGT |
| Y221L | CTT | G225D | GAT | Q228G | GGT | Q231L | CTG |
| Y221E | GAG | G225R | CGT | Q228H | CAT | Q231D | GAT |
| T222L | TTG | G225Q | CAG | Q228K | AAG | Q231G | GGT |
| T222Y | TAT | G225M | ATG | Q228L | CTG | Q231V | GTT |
| T222R | CGT | G225P | CCT | Q228M | ATG | Q231W | TGG |
| T222V | GTT | G225W | TGG | Q228N | AAT | Q231S | AGT |
| T222P | CCT | G225S | TCT | Q228P | CCG | Q231H | CAT |
| T222S | AGT | G225E | GAG | Q228R | CGG | Q231C | TGT |
| T222A | GCT | G225V | GTT | Q228S | TCT | Q231M | ATG |
| T222H | CAT | G225T | ACG | Q228T | ACG | D232H | CAT |
| T222G | GGG | G225K | AAG | Q228W | TGG | D232G | GGG |
| T222M | ATG | G225N | AAT | Q228Y | TAT | D232R | CGT |
| T222F | TTT | G225C | TGT | L229R | CGG | D232P | CCT |
| T222C | TGT | G225H | CAT | L229A | GCG | D232Y | TAT |
| T222I | ATT | G225A | GCG | L229T | ACG | D232N | AAT |
| T222N | AAT | D226S | TCT | L229Q | CAG | D232S | TCG |
| T222W | TGG | D226W | TGG | L229P | CCT | D232F | TTT |
| T222D | GAT | D226R | CGG | L229E | GAG | D232V | GTG |
| F223L | TTG | D226A | GCT | L229W | TGG | D232K | AAG |
| F223T | ACG | D226N | AAT | L229M | ATG | D232W | TGG |
| F223C | TGT | D226T | ACT | L229I | ATT | D232Q | CAG |
| F223R | CGT | D226E | GAG | L229G | GGT | D232E | GAG |
| F223N | AAT | D226L | CTT | L229C | TGT | D232T | ACT |
| F223P | CCT | D226P | CCT | L229Y | TAT | D232L | CTG |
| F223E | GAG | D226H | CAT | L229D | GAT | D233Q | CAG |
| F223G | GGG | D226G | GGT | L229H | CAT | D233P | CCG |
| F223Q | CAG | D226I | ATT | L229V | GTG | D233S | TCT |
| F223A | GCG | D226M | ATG | A230L | TTG | D233T | ACG |
| F223S | TCT | D226V | GTG | A230G | GGT | D233A | GCG |
| F223Y | TAT | D226C | TGT | A230W | TGG | D233W | TGG |
| F223H | CAT | V227A | GCT | A230P | CCG | D233G | GGT |

TABLE 21-continued

| Codons encoding each amino acid substitution | | | | | | | |
|---|---|---|---|---|---|---|---|
| Mutation | Codon | Mutation | Codon | Mutation | Codon | Mutation | Codon |
| F223K | AAG | V227C | TGT | A230D | GAT | D233R | CGT |
| F223M | ATG | V227D | GAT | A230R | CGT | D233E | GAG |
| S224G | GGG | V227E | GAG | A230I | ATT | D233N | AAT |
| D233V | GTG | G236N | AAT | I240G | GGG | R243L | CTT |
| D233M | ATG | G236F | TTT | I240Q | CAG | R243A | GCG |
| D233L | CTG | I237S | TCG | I240P | CCG | R243H | CAT |
| D233K | AAG | I237L | CTG | I240R | CGG | R243Q | CAG |
| D233I | ATT | I237R | CGT | I240S | TCG | R243S | AGT |
| I234A | GCT | I237Q | CAG | I240K | AAG | R243I | ATT |
| I234T | ACG | I237K | AAG | I240V | GTG | R243C | TGT |
| I234V | GTT | I237D | GAT | I240D | GAT | R243N | AAT |
| I234W | TGG | I237A | GCG | I240A | GCG | R243Y | TAT |
| I234E | GAG | I237T | ACG | I240C | TGT | R243G | GGG |
| I234G | GGT | I237E | GAG | I240L | CTT | R243D | GAT |
| I234L | CTT | I237C | TGT | I240F | TTT | R243V | GTG |
| I234H | CAT | I237G | GGG | I240Y | TAT | S244P | CCG |
| I234M | ATG | I237P | CCT | I240M | ATG | S244L | CTT |
| I234N | AAT | I237Y | TAT | I240T | ACG | S244W | TGG |
| I234Y | TAT | I237W | TGG | Y241V | GTT | S244M | ATG |
| I234P | CCT | I237N | AAT | Y241A | GCT | S244V | GTT |
| I234D | GAT | Q238G | GGG | Y241G | GGG | S244Q | CAG |
| I234Q | CAG | Q238H | CAT | Y241H | CAT | S244D | GAT |
| I234C | TGT | Q238S | TCG | Y241R | CGG | S244E | GAG |
| D235H | CAT | Q238Y | TAT | Y241P | CCG | S244T | ACG |
| D235G | GGG | Q238F | TTT | Y241Q | CAG | S244H | CAT |
| D235A | GCG | Q238E | GAG | Y241L | TTG | S244G | GGT |
| D235P | CCG | Q238L | TTG | Y241T | ACG | S244A | GCT |
| D235L | CTT | Q238W | TGG | Y241S | AGT | S244F | TTT |
| D235V | GTG | Q238P | CCG | Y241W | TGG | S244Y | TAT |
| D235E | GAG | Q238R | AGG | Y241N | AAT | S244R | CGT |
| D235R | CGT | Q238C | TGT | Y241M | ATG | Q245P | CCT |
| D235Q | CAG | Q238N | AAT | Y241I | ATT | Q245I | ATT |
| D235T | ACG | Q238I | ATT | Y241D | GAT | Q245F | TTT |
| D235C | TGT | Q238T | ACG | G242A | GCG | Q245V | GTT |
| D235S | TCG | Q238K | AAG | G242F | TTT | Q245M | ATG |
| D235N | AAT | A239S | TCT | G242L | CTT | Q245T | ACT |
| D235Y | TAT | A239Q | CAG | G242N | AAT | Q245E | GAG |
| D235I | ATT | A239T | ACG | G242P | CCT | Q245S | TCG |

TABLE 21-continued

Codons encoding each amino acid substitution

| Mutation | Codon | Mutation | Codon | Mutation | Codon | Mutation | Codon |
|---|---|---|---|---|---|---|---|
| G236M | ATG | A239P | CCT | G242W | TGG | Q245R | CGG |
| G236R | CGG | A239V | GTG | G242T | ACG | Q245G | GGT |
| G236D | GAT | A239L | CTG | G242R | CGT | Q245H | CAT |
| G236S | TCT | A239Y | TAT | G242V | GTT | Q245L | CTT |
| G236T | ACT | A239I | ATT | G242S | TCG | Q245K | AAG |
| G236C | TGT | A239C | TGT | G242I | ATT | Q245W | TGG |
| G236K | AAG | A239G | GGG | G242Y | TAT | Q245C | TGT |
| G236E | GAG | A239W | TGG | G242H | CAT | N246W | TGG |
| G236P | CCG | A239F | TTT | G242E | GAG | N246R | CGG |
| G236I | ATT | A239K | AAG | G242K | AAG | N246A | GCG |
| G236Y | TAT | A239H | CAT | R243P | CCG | N246F | TTT |
| G236L | CTG | A239R | CGT | R243K | AAG | N246G | GGT |
| G236V | GTT | A239D | GAT | R243T | ACG | N246P | CCT |
| N246V | GTT | Q249G | GGT | G252P | CCT | T255L | TTG |
| N246Q | CAG | Q249N | AAT | G252H | CAT | T255H | CAT |
| N246Y | TAT | Q249K | AAG | G252C | TGT | P256S | AGT |
| N246C | TGT | Q249I | ATT | G252V | GTT | P256V | GTG |
| N246I | ATT | Q249Y | TAT | G252I | ATT | P256F | TTT |
| N246L | TTG | Q249V | GTG | P253C | TGT | P256Y | TAT |
| N246S | TCT | Q249L | TTG | P253G | GGT | P256I | ATT |
| N246T | ACT | Q249H | CAT | P253Q | CAG | P256A | GCT |
| N246K | AAG | P250L | CTG | P253I | ATT | P256L | CTT |
| N246D | GAT | P250S | TCG | P253L | CTG | P256G | GGT |
| P247A | GCG | P250R | CGG | P253R | CGG | P256N | AAT |
| P247D | GAT | P250Y | TAT | P253A | GCT | P256R | CGG |
| P247E | GAG | P250M | ATG | P253E | GAG | P256Q | CAG |
| P247F | TTT | P250F | TTT | P253Y | TAT | P256E | GAG |
| P247G | GGG | P250A | GCT | P253W | TGG | P256K | AAG |
| P247H | CAT | P250K | AAG | P253M | ATG | P256M | ATG |
| P247I | ATT | P250G | GGT | P253V | GTG | P256C | TGT |
| P247K | AAG | P250N | AAT | P253T | ACT | K257C | TGT |
| P247L | CTG | P250T | ACT | P253K | AAG | K257M | ATG |
| P247N | AAT | P250W | TGG | P253N | AAT | K257V | GTT |
| P247Q | CAG | P250D | GAT | Q254R | CGT | K257A | GCT |
| P247R | CGT | P250V | GTG | Q254G | GGG | K257E | GAG |
| P247S | TCG | P250Q | CAG | Q254W | TGG | K257S | TCT |
| P247T | ACG | I251A | GCG | Q254T | ACT | K257L | CTT |
| P247V | GTT | I251Q | CAG | Q254A | GCT | K257I | ATT |

TABLE 21-continued

Codons encoding each amino acid substitution

| Mutation | Codon | Mutation | Codon | Mutation | Codon | Mutation | Codon |
|---|---|---|---|---|---|---|---|
| V248W | TGG | I251G | GGG | Q254F | TTT | K257G | GGG |
| V248L | CTG | I251L | CTG | Q254D | GAT | K257N | AAT |
| V248Q | CAG | I251K | AAG | Q254P | CCG | K257F | TTT |
| V248M | ATG | I251R | CGT | Q254L | CTG | K257W | TGG |
| V248Y | TAT | I251E | GAG | Q254C | TGT | K257R | CGG |
| V248G | GGG | I251D | GAT | Q254Y | TAT | K257P | CCG |
| V248C | TGT | I251T | ACG | Q254I | ATT | K257T | ACT |
| V248R | CGG | I251C | TGT | Q254E | GAG | A258Q | CAG |
| V248A | GCG | I251Y | TAT | Q254V | GTG | A258Y | TAT |
| V248H | CAT | I251P | CCT | Q254S | TCT | A258W | TGG |
| V248I | ATT | I251S | TCT | T255I | ATT | A258G | GGG |
| V248T | ACT | I251W | TGG | T255Q | CAG | A258L | TTG |
| V248K | AAG | I251V | GTT | T255P | CCG | A258F | TTT |
| V248S | TCG | G252F | TTT | T255R | CGT | A258M | ATG |
| V248F | TTT | G252W | TGG | T255C | TGT | A258N | AAT |
| V248E | GAG | G252A | GCG | T255N | AAT | A258V | GTG |
| Q249T | ACT | G252R | CGG | T255S | AGT | A258T | ACG |
| Q249W | TGG | G252L | CTT | T255V | GTG | A258I | ATT |
| Q249R | CGG | G252E | GAG | T255E | GAG | A258D | GAT |
| Q249E | GAG | G252D | GAT | T255G | GGG | A258R | CGT |
| Q249A | GCT | G252K | AAG | T255K | AAG | A258E | GAG |
| Q249P | CCG | G252S | TCG | T255A | GCT | A258P | CCG |
| Q249C | TGT | G252T | ACG | T255F | TTT | T255L | TTG |

The DNA encoding each individual library member was generated according to standard DNA synthesis protocols and expressed using routine molecular biology techniques. Briefly, the DNA was ligated into vector pET303CTHis (Invitrogen, SEQ ID NO: 533) using routine molecular biology techniques. Plasmid containing one individual hMMP-1 mutant was transformed into BL21 (DE3) *E. coli* cells (Tigen, Beiging, China) using manufacturers recommendations. The process was repeated for all library members. The transformation culture was used to inoculate 1 mL LB medium containing ampicillin additives. The culture was grown at 37° C. with shaking for 16 hours. Protein expression was induced by the addition of 1 mM isopropyl-β-D-thiogalactoside (IPTG) and the culture was incubated at 25° C. with shaking. After 6 hours, the cells were pelleted by centrifugation at 6,000 g for 10 minutes and the supernatant was removed. The periplasmic protein was enriched by incubating the cells in 50 μl OS buffer (200 mM Tris-HCV, pH 7.5, 20% sucrose, 1 mM EDTA) with 4 μl DNAse (10 μg/ml), 4 μl RNAse (10 μg/ml), and 4 μl lysozyme (10 μg/ml) for 10 minutes at 25° C. 50 μl of water was added to each well followed by centrifugation at 6000 g for 10 minutes to remove cell debris. The supernatant, containing the hMMP-1 protein, was stored at −20° C. Activity of supernatants were screened as described in the following examples.

B. Cloning and Expression of Wild Type hMMP-1

In this example, wild type hMMP-1 was individually expressed in both *E. coli* and CHO-S cells.

1. Expression in *E. coli*

Wild type hMMP-1 (clone BAP006_10, having a sequence of nucleotides set forth in SEQ ID NO: 534) was cloned into vector pET303CTHis (Invitrogen, SEQ ID NO:533) and grown in BL21 (DE3) *E. coli*. The pET303CTHis vector contained a C-terminal His tag (SEQ ID NO:235). Protein expression was induced upon the addition of 1 mM isopropyl-β-D-thiogalactoside (IPTG) as described above. Following expression, the protein was enriched as described in Example 27A, and subsequently purified using a HiTrap Ni$^{2+}$ column (GE Healthcare) according to standard molecular biology protocols. Expression and purification were monitored by SDS/PAGE and Western blot analysis.

2. Expression in CHO-S Cells

Wild type hMMP-1 (clone BAP006_2, having a sequence of nucleotides set forth in SEQ ID NO: 534) was expressed

EXAMPLE 28

Determination of Enzymatic Activity of the hMMP-1 Mutants using a Fluorogenic Peptide Substrate In this example, the hMMP-1 mutant library, generated in Example 27, was screened using a high throughput fluorescence activity assay to identify temperature sensitive hMMP-1 mutants. To screen for temporally sensitive hMMP-1 mutants, the enzymtic activity of each individual mutant was determined at 25° C. and 37° C. and/or 34° C., using a commercially available fluorogenic substrate, peptide IX, designated as Mca-K-P-L-G-L-Dpa-A-R-NH$_2$ (SEQ ID NO: 535; Mca=(7-Methoxycoumarin-4-yl)acetyl; Dpa=N-3-(2,4,-Dinitrophenyl)-L-2,3-diaminopropionyl; R&D Systems, Minneapolis, Minn., Cat# ES101). The peptide substrate contains a highly fluororescent 7-methoxycoumarin group that is quenched by resonance energy transfer to the 2,4-dinitrophenyl group. Activated hMMP-1 cleaves the amide bond between glycine and leucine resulting in an increase in released fluorescence. Reactions were initially performed in a 96-well assay and confirmed using a 14 ml tube format.

A. 96-well Assay

Prior to assessing activity of the supernatants, supernatants were treated with a processing agent to activate the inactive zymogen form into an active enzyme. Briefly, 411 of each hMMP-1 mutant supernatant generated in Example 27 was added to 100 μl of TCNB (50 nM Tris, 10 mM CaCl$_2$, 150 mM NaCl, 0.05% Brij 35, pH 7.5) with 1 mM of the processing agent p-aminophenylmercuric acetate (APMA) in a 96-well plate. The solution was incubated at the reaction temperature (either 25° C. or 37° C.) for 2 hours. This activation step cleaves the pro-peptide and generates mature hMMP-1.

Following activation, 1.6 μl of TCNB containing 620 μM Mca-K-P-L-G-L-Dpa-A-R-NH$_2$ (SEQ ID NO. 535; Mca=(7-Methoxycoumarin-4-yl)acetyl; Dpa=N-3 -(2,4,-Dinitrophenyl)-L-2,3-diaminopropionyl) fluorescent substrate was added to each well to a final concentration of 10 μM, at the indicated reaction temperature (either 25° C. or 37° C.) for 1 hour. Fluorescence was detected by measuring fluorescence in a fluorescent plate reader at 320 m exitation/405 nm emission. Relative fluorescence units (RFU) were determined. Supernatant from wild type hMMP-1 and plasmid/vector transformed cells were used as positive and negative controls. Duplicate reactions were performed for each sample, reaction temperature, and positive and negative control.

From the initial screen of 2687 hMMP-1 mutants, 199 putative primary hits were identified (see Table 22) with reduced activity at 37° C. These hMMP-1 mutants were rescreened, using the same assay, and 104 primary hits were confirmed (see Table 23, below). hMMP-1 mutants that were active at 25° C. and had at least a 16% decrease in activity at 37° C. (e.g., the ratio of the activities at 25° C. or 37° C. (25° C./37° C.) is greater than or equal to 1.2) were deemed to be confirmed primary temperature sensitive hits. Table 22, below, lists the hMMP-1 mutation, the average RFU at 25° C. and 37° C., and the ratio of the activities (25° C./37° C.). The Table also lists the temperature phenotype:DOWN, indicates the ratio (25° C./37° C.) of the activity of the mutant is decreased compared to the ratio (25° C./37° C.) of the activity of the wild-type, i.e. decreased greater than 16% the activity of the wild type; NEUTRAL, indicates the ratio (25° C./37° C.) of the activity of the mutant is similar to the ratio (25° C./37° C.) of the activity of wild-type, i.e. within 16% of the activity of the wild type; and UP, indicates the ratio (25° C./37° C.) of the activity of the mutant is increased compared to the ratio (25° C./37° C.) of the activity of the wild-type, i.e. increased more than 16% the activity of the wild type.

Table 22, below, also lists the residual activities at 25° C. and 37° C., as compared to wild type hMMP-1. The residual activity is the ratio of the hMMP-1 mutant activity versus the wildtype hMMP-1 activity at the indicated temperature, either 25° C. or 37° C. Several of the hMMP-1 mutants had activities that were comparable to, or greater than, wildtype hMMP-1 at 25° C. while they all exhibited decreased activities at 37° C., thereby reconfirming their decreased activity at elevated temperatures.

TABLE 22

Results of Initial Screen for Temperature Sensitive hMMP-1 mutants

| Temp. Phenotype | hMMP-1 mutation | SEQ ID NO | Avg. RFU 25° C. | Avg. RFU 37° C. | Ratio 25° C./37° C. | Res. Act. Mut/wt 25° C. | Res. Act. Mut/wt 37° C. |
|---|---|---|---|---|---|---|---|
| Neutral | T84F | 479 | 6312.72 | 6453.46 | 0.98 | 1.10 | 1.27 |
| Neutral | E85F | 480 | 6092.47 | 6362.37 | 0.96 | 1.06 | 1.26 |
| Up | L95K | 328 | 1333.28 | 1191.46 | 1.12 | 0.15 | 0.14 |
| Down | L95I | 329 | 1707.98 | 2294.02 | 0.74 | 0.30 | 0.45 |
| Down | R98D | 481 | 2905.96 | 3867.31 | 0.75 | 0.33 | 0.47 |
| Down | I99Q | 482 | 3318.21 | 4623.91 | 0.72 | 0.37 | 0.56 |
| Down | E100V | 457 | 3980.72 | 5009.20 | 0.79 | 1.26 | 1.01 |
| Neutral | E100R | 451 | 7410.11 | 7964.52 | 0.93 | 0.83 | 0.96 |
| Neutral | E100S | 454 | 3768.09 | 4664.58 | 0.81 | 0.42 | 0.56 |
| Neutral | E100T | 453 | 6985.28 | 7478.12 | 0.93 | 0.79 | 0.90 |
| Neutral | E100F | 455 | 6709.27 | 7436.60 | 0.90 | 0.75 | 0.90 |
| Neutral | E100I | 456 | 8824.19 | 8458.79 | 1.04 | 0.99 | 1.02 |
| Neutral | E100N | 452 | 8809.68 | 8215.63 | 1.07 | 0.99 | 0.99 |
| Neutral | T103Y | 458 | 1181.09 | 1423.76 | 0.83 | 0.37 | 0.29 |
| Neutral | P104A | 484 | 8861.30 | 8360.82 | 1.06 | 1.00 | 1.01 |
| Up | P104M | 483 | 6709.44 | 7118.65 | 0.94 | 0.88 | 0.75 |
| Up | D105A | 340 | 2674.16 | 1227.06 | 2.18 | 0.65 | 0.24 |

TABLE 22-continued

Results of Initial Screen for Temperature Sensitive hMMP-1 mutants

| Temp. Phenotype | hMMP-1 mutation | SEQ ID NO | Avg. RFU 25° C. | Avg. RFU 37° C. | Ratio 25° C./37° C. | Res. Act. Mut/wt 25° C. | Res. Act. Mut/wt 37° C. |
|---|---|---|---|---|---|---|---|
| Up | D105F | 336 | 2009.56 | 1221.58 | 1.65 | 0.49 | 0.24 |
| Up | D105G | 335 | 2407.89 | 1686.68 | 1.43 | 0.58 | 0.34 |
| Up | D105I | 338 | 1732.38 | 1105.99 | 1.57 | 0.42 | 0.22 |
| Up | D105L | 339 | 1563.61 | 859.56 | 1.82 | 0.38 | 0.17 |
| Up | D105N | 332 | 3766.72 | 1475.08 | 2.55 | 0.91 | 0.29 |
| Up | D105R | 331 | 3892.02 | 2016.90 | 1.93 | 0.94 | 0.40 |
| Up | D105S | 334 | 3646.49 | 2727.22 | 1.34 | 0.88 | 0.54 |
| Up | D105T | 333 | 2513.64 | 1729.46 | 1.45 | 0.61 | 0.34 |
| Up | D105W | 337 | 2565.93 | 1855.05 | 1.38 | 0.62 | 0.37 |
| Neutral | D105E | 330 | 4000.92 | 3366.64 | 1.19 | 0.59 | 0.45 |
| Neutral | L106C | 485 | 2995.56 | 3678.33 | 0.81 | 0.34 | 0.44 |
| Neutral | L106S | 486 | 2730.64 | 2899.36 | 0.94 | 0.31 | 0.35 |
| Neutral | A109H | 487 | 7206.01 | 7536.96 | 0.96 | 0.81 | 0.91 |
| Neutral | D110A | 488 | 4179.59 | 5112.44 | 0.82 | 0.47 | 0.62 |
| Neutral | V111R | 489 | 2401.69 | 2925.16 | 0.82 | 0.27 | 0.35 |
| Neutral | D112S | 490 | 7203.69 | 7600.93 | 0.95 | 0.81 | 0.92 |
| Neutral | A118T | 491 | 745.83 | 665.63 | 1.12 | 0.13 | 0.13 |
| Down | S123V | 492 | 3220.29 | 4504.25 | 0.71 | 0.41 | 0.60 |
| Neutral | N124D | 493 | 6218.73 | 6620.92 | 0.94 | 0.92 | 0.88 |
| Neutral | T126S | 494 | 7114.42 | 6856.69 | 1.04 | 1.06 | 0.91 |
| Up | G147P | 495 | 494.94 | 392.93 | 1.26 | 0.07 | 0.05 |
| Up | R150P | 345 | 2291.14 | 828.28 | 2.77 | 0.31 | 0.12 |
| Neutral | R150V | 344 | 6869.28 | 6604.61 | 1.04 | 1.20 | 1.30 |
| Neutral | R150D | 341 | 7230.41 | 6033.28 | 1.20 | 1.26 | 1.19 |
| Down | R150I | 343 | 3120.05 | 4082.34 | 0.76 | 0.39 | 0.55 |
| Neutral | R150H | 342 | 8281.04 | 8056.17 | 1.03 | 1.05 | 1.08 |
| Up | D151G | 346 | 1073.32 | 733.89 | 1.46 | 0.20 | 0.11 |
| Neutral | N152A | 497 | 6669.94 | 5660.16 | 1.18 | 1.17 | 1.12 |
| Down | N152S | 496 | 4607.85 | 8096.31 | 0.57 | 0.58 | 1.08 |
| Neutral | S153T | 459 | 10530.07 | 8798.72 | 1.20 | 1.44 | 1.24 |
| Up | F155L | 347 | 1322.13 | 864.19 | 1.53 | 0.25 | 0.13 |
| Up | F155A | 348 | 1250.93 | 760.12 | 1.65 | 0.23 | 0.11 |
| Up | D156H | 349 | 2722.09 | 2081.55 | 1.31 | 0.51 | 0.31 |
| Up | D156L | 356 | 2548.30 | 1597.53 | 1.60 | 0.48 | 0.24 |
| Up | D156A | 357 | 2679.29 | 1734.45 | 1.54 | 0.50 | 0.26 |
| Up | D156W | 354 | 1575.39 | 1268.36 | 1.24 | 0.30 | 0.19 |
| Up | D156V | 355 | 1400.88 | 766.80 | 1.83 | 0.26 | 0.11 |
| Up | D156K | 350 | 1292.89 | 966.62 | 1.34 | 0.24 | 0.14 |
| Up | D156T | 352 | 2871.09 | 1843.03 | 1.56 | 0.54 | 0.27 |
| Up | D156R | 351 | 2431.23 | 1545.89 | 1.57 | 0.46 | 0.23 |
| Up | D156M | 353 | 817.96 | 502.82 | 1.63 | 0.12 | 0.07 |
| Neutral | P158T | 500 | 4204.23 | 3507.76 | 1.20 | 0.53 | 0.47 |
| Neutral | P158G | 501 | 6277.86 | 5496.27 | 1.14 | 0.79 | 0.73 |
| Neutral | P158K | 498 | 6860.82 | 6680.30 | 1.03 | 0.87 | 0.89 |
| Neutral | P158N | 499 | 3656.04 | 3874.48 | 0.94 | 0.46 | 0.52 |
| Up | G159V | 363 | 2453.98 | 732.46 | 3.35 | 0.34 | 0.10 |
| Up | G159T | 359 | 5059.91 | 1734.12 | 2.92 | 0.69 | 0.24 |
| Up | G159M | 360 | 5905.06 | 4874.00 | 1.21 | 0.75 | 0.65 |
| Neutral | G159I | 362 | 5725.99 | 5357.20 | 1.07 | 0.72 | 0.72 |
| Neutral | G159W | 361 | 6787.40 | 6287.71 | 1.08 | 0.86 | 0.84 |
| Neutral | G159L | 364 | 8231.62 | 7638.64 | 1.08 | 1.04 | 1.02 |
| Neutral | G159C | 358 | 2897.77 | 3053.86 | 0.95 | 0.37 | 0.41 |
| Neutral | P170D | 502 | 1434.38 | 1462.91 | 0.98 | 0.25 | 0.29 |
| Neutral | P170A | 503 | 2733.72 | 2793.24 | 0.98 | 0.48 | 0.55 |
| Up | G171P | 462 | 1570.74 | 1204.39 | 1.30 | 0.27 | 0.17 |
| Neutral | G171E | 461 | 1154.96 | 1199.65 | 0.96 | 0.20 | 0.24 |
| Neutral | G171D | 460 | 791.81 | 690.33 | 1.15 | 0.14 | 0.14 |
| Up | A176F | 365 | 10486.82 | 6516.31 | 1.61 | 1.31 | 0.78 |
| Neutral | A176W | 366 | 482.38 | 414.85 | 1.16 | 0.06 | 0.06 |
| Neutral | F178T | 504 | 560.54 | 487.01 | 1.15 | 0.10 | 0.10 |
| Up | F178L | 505 | 1788.95 | 1314.38 | 1.36 | 0.31 | 0.26 |
| Up | D179N | 368 | 2433.73 | 812.01 | 3.00 | 0.26 | 0.10 |
| Up | D179V | 369 | 604.63 | 490.35 | 1.23 | 0.11 | 0.10 |
| Up | D179C | 367 | 613.81 | 503.76 | 1.22 | 0.11 | 0.10 |
| Up | E180Y | 374 | 6655.19 | 5379.42 | 1.24 | 0.72 | 0.63 |
| Neutral | E180R | 371 | 6932.51 | 6309.81 | 1.10 | 0.75 | 0.74 |
| Up | E180T | 373 | 3718.16 | 2425.13 | 1.53 | 0.40 | 0.29 |
| Up | E180F | 377 | 7014.78 | 5382.78 | 1.30 | 0.76 | 0.63 |
| Up | E180G | 376 | 5952.65 | 4547.28 | 1.31 | 1.04 | 0.90 |
| Up | E180S | 375 | 5217.80 | 3977.60 | 1.31 | 0.91 | 0.78 |
| Up | E180N | 372 | 6534.65 | 4843.84 | 1.35 | 1.14 | 0.96 |
| Up | E180D | 370 | 7738.70 | 6277.22 | 1.23 | 1.35 | 1.24 |
| Neutral | D181T | 380 | 6867.00 | 6057.09 | 1.13 | 0.74 | 0.71 |

TABLE 22-continued

Results of Initial Screen for Temperature Sensitive hMMP-1 mutants

| Temp. Phenotype | hMMP-1 mutation | SEQ ID NO | Avg. RFU 25° C. | Avg. RFU 37° C. | Ratio 25° C./37° C. | Res. Act. Mut/wt 25° C. | Res. Act. Mut/wt 37° C. |
|---|---|---|---|---|---|---|---|
| Up | D181L | 382 | 1727.20 | 1274.09 | 1.36 | 0.19 | 0.15 |
| Up | D181K | 378 | 1087.36 | 696.83 | 1.56 | 0.12 | 0.08 |
| Up | D181C | 379 | 549.29 | 447.40 | 1.23 | 0.10 | 0.09 |
| Up | D181G | 381 | 2764.20 | 2056.56 | 1.34 | 0.48 | 0.41 |
| Up | E182T | 384 | 2995.97 | 1779.42 | 1.68 | 0.32 | 0.21 |
| Up | E182Q | 383 | 1393.28 | 804.84 | 1.73 | 0.15 | 0.09 |
| Up | E182M | 386 | 649.73 | 524.43 | 1.24 | 0.11 | 0.10 |
| Neutral | E182G | 385 | 604.92 | 543.78 | 1.11 | 0.11 | 0.11 |
| Up | R183G | 507 | 7326.36 | 6021.39 | 1.22 | 1.28 | 1.19 |
| Up | R183S | 506 | 7896.17 | 6240.74 | 1.27 | 1.38 | 1.23 |
| Up | T185R | 390 | 1728.04 | 851.07 | 2.03 | 0.20 | 0.10 |
| Up | T185Y | 392 | 937.75 | 540.66 | 1.73 | 0.11 | 0.07 |
| Up | T185H | 389 | 1448.04 | 783.89 | 1.85 | 0.17 | 0.10 |
| Up | T185G | 393 | 3922.30 | 1990.15 | 1.97 | 0.46 | 0.24 |
| Up | T185V | 394 | 1648.14 | 897.66 | 1.84 | 0.19 | 0.11 |
| Up | T185Q | 391 | 1594.81 | 583.93 | 2.73 | 0.19 | 0.07 |
| Up | T185A | 395 | 1599.64 | 711.08 | 2.25 | 0.19 | 0.09 |
| Up | T185E | 388 | 1324.02 | 703.76 | 1.88 | 0.16 | 0.09 |
| Neutral | T185D | 387 | 485.86 | 418.67 | 1.16 | 0.06 | 0.06 |
| Up | N187R | 398 | 1042.36 | 709.74 | 1.47 | 0.12 | 0.09 |
| Up | N187M | 402 | 1731.67 | 995.07 | 1.74 | 0.20 | 0.12 |
| Neutral | N187W | 403 | 1694.86 | 1425.68 | 1.19 | 0.20 | 0.17 |
| Up | N187F | 401 | 1240.41 | 731.98 | 1.69 | 0.15 | 0.09 |
| Up | N187K | 397 | 2331.93 | 1140.19 | 2.05 | 0.27 | 0.14 |
| Up | N187I | 404 | 1444.98 | 683.03 | 2.12 | 0.17 | 0.08 |
| Up | N187A | 405 | 4379.80 | 2616.49 | 1.67 | 0.52 | 0.32 |
| Neutral | N187G | 400 | 535.06 | 514.10 | 1.04 | 0.07 | 0.07 |
| Neutral | N187C | 399 | 1804.28 | 1860.67 | 0.97 | 0.23 | 0.25 |
| Neutral | N187H | 396 | 1143.07 | 1071.67 | 1.07 | 0.14 | 0.14 |
| Up | F188V | 508 | 7116.29 | 5860.00 | 1.21 | 1.24 | 1.16 |
| Neutral | R189N | 509 | 7842.39 | 6675.36 | 1.17 | 1.37 | 1.32 |
| Neutral | R189T | 511 | 7610.10 | 6459.94 | 1.18 | 1.33 | 1.27 |
| Neutral | R189Q | 510 | 7465.37 | 6396.79 | 1.17 | 1.30 | 1.26 |
| Up | E190G | 465 | 5313.99 | 4365.93 | 1.22 | 0.75 | 0.48 |
| Up | E190Y | 464 | 7243.54 | 5742.33 | 1.26 | 1.27 | 1.13 |
| Up | E190D | 463 | 7910.21 | 6468.78 | 1.22 | 1.38 | 1.28 |
| Up | Y191V | 466 | 1553.58 | 1254.11 | 1.24 | 0.19 | 0.14 |
| Up | N192H | 468 | 2274.24 | 1058.80 | 2.15 | 0.32 | 0.12 |
| Up | N192S | 470 | 2043.65 | 1630.74 | 1.25 | 0.29 | 0.18 |
| Up | N192D | 467 | 4213.33 | 2216.40 | 1.90 | 0.59 | 0.24 |
| Up | N192C | 469 | 1310.46 | 987.31 | 1.33 | 0.18 | 0.11 |
| Neutral | H194P | 471 | 5264.79 | 5058.19 | 1.04 | 0.74 | 0.56 |
| Up | R195C | 407 | 4231.32 | 1853.20 | 2.28 | 0.60 | 0.20 |
| Neutral | R195W | 410 | 5099.23 | 4524.84 | 1.13 | 0.72 | 0.50 |
| Neutral | R195L | 412 | 5073.57 | 4520.73 | 1.12 | 0.72 | 0.50 |
| Up | R195G | 409 | 5269.21 | 3025.93 | 1.74 | 0.74 | 0.33 |
| Up | R195Q | 408 | 1958.69 | 1361.83 | 1.44 | 0.28 | 0.15 |
| Up | R195A | 413 | 5605.90 | 3852.81 | 1.46 | 0.79 | 0.42 |
| Up | R195D | 406 | 2724.53 | 1907.81 | 1.43 | 0.38 | 0.21 |
| Up | R195V | 411 | 1711.48 | 1037.62 | 1.65 | 0.24 | 0.11 |
| Up | A197C | 512 | 4012.80 | 3140.52 | 1.28 | 0.70 | 0.62 |
| Neutral | A198G | 414 | 2610.82 | 2368.26 | 1.10 | 0.37 | 0.26 |
| Up | A198L | 416 | 1339.94 | 726.74 | 1.84 | 0.19 | 0.08 |
| Up | A198M | 415 | 1384.46 | 999.55 | 1.39 | 0.20 | 0.11 |
| Up | G206A | 418 | 4554.61 | 2702.11 | 1.69 | 0.47 | 0.30 |
| Up | G206S | 417 | 1226.37 | 919.66 | 1.33 | 0.13 | 0.10 |
| Up | L207R | 472 | 3476.88 | 1332.44 | 2.61 | 0.36 | 0.15 |
| Neutral | L207V | 475 | 656.95 | 550.54 | 1.19 | 0.08 | 0.07 |
| Neutral | L207I | 474 | 645.37 | 550.32 | 1.17 | 0.08 | 0.07 |
| Up | L207G | 473 | 610.01 | 484.35 | 1.26 | 0.08 | 0.06 |
| Neutral | S208R | 513 | 7639.06 | 6465.10 | 1.18 | 1.34 | 1.28 |
| Up | S208L | 514 | 7811.78 | 6354.14 | 1.23 | 1.37 | 1.25 |
| Up | S210V | 419 | 1190.35 | 856.63 | 1.39 | 0.29 | 0.17 |
| Neutral | S210A | 420 | 1682.05 | 1546.97 | 1.09 | 0.25 | 0.21 |
| Neutral | T211L | 515 | 2376.23 | 2102.07 | 1.13 | 0.35 | 0.28 |
| Up | D212G | 477 | 1011.62 | 657.28 | 1.54 | 0.24 | 0.13 |
| Neutral | D212H | 476 | 4696.49 | 4001.41 | 1.17 | 0.70 | 0.53 |
| Up | Y218S | 421 | 3702.49 | 3099.73 | 1.19 | 0.58 | 0.43 |
| Up | F223C | 424 | 3115.11 | 2488.91 | 1.25 | 0.53 | 0.35 |
| Up | F223E | 422 | 7194.34 | 5884.03 | 1.22 | 1.22 | 0.83 |
| Up | F223G | 426 | 3236.56 | 2599.04 | 1.25 | 0.55 | 0.36 |
| Up | F223A | 428 | 5226.86 | 3982.92 | 1.31 | 0.89 | 0.56 |
| Up | F223S | 425 | 6006.80 | 4916.07 | 1.22 | 1.02 | 0.69 |

TABLE 22-continued

Results of Initial Screen for Temperature Sensitive hMMP-1 mutants

| Temp. Phenotype | hMMP-1 mutation | SEQ ID NO | Avg. RFU 25° C. | Avg. RFU 37° C. | Ratio 25° C./37° C. | Res. Act. Mut/wt 25° C. | Res. Act. Mut/wt 37° C. |
|---|---|---|---|---|---|---|---|
| Neutral | F223K | 423 | 4021.97 | 3712.91 | 1.08 | 0.60 | 0.49 |
| Neutral | F223M | 427 | 525.66 | 441.29 | 1.19 | 0.08 | 0.06 |
| Up | V227C | 433 | 4040.96 | 3278.65 | 1.23 | 0.68 | 0.46 |
| Up | V227D | 429 | 1190.09 | 731.34 | 1.63 | 0.20 | 0.10 |
| Up | V227E | 430 | 5381.63 | 2605.20 | 2.07 | 0.91 | 0.37 |
| Up | V227L | 438 | 4883.98 | 4000.68 | 1.22 | 0.83 | 0.56 |
| Up | V227S | 435 | 3863.33 | 3131.47 | 1.23 | 0.65 | 0.44 |
| Up | V227W | 437 | 1845.46 | 1374.06 | 1.34 | 0.31 | 0.19 |
| Neutral | V227G | 436 | 1040.74 | 883.01 | 1.18 | 0.15 | 0.12 |
| Up | V227H | 431 | 689.20 | 504.65 | 1.37 | 0.10 | 0.07 |
| Up | V227Q | 434 | 696.97 | 506.11 | 1.38 | 0.10 | 0.07 |
| Neutral | V227R | 432 | 664.31 | 561.06 | 1.18 | 0.10 | 0.07 |
| Up | Q228P | 439 | 2862.74 | 1291.55 | 2.22 | 1.33 | 0.44 |
| Up | L229A | 442 | 2627.78 | 2118.07 | 1.24 | 1.22 | 0.72 |
| Up | L229T | 440 | 3780.54 | 1464.25 | 2.58 | 1.75 | 0.50 |
| Up | L229I | 441 | 1158.56 | 828.94 | 1.40 | 0.54 | 0.28 |
| Up | A230V | 478 | 5030.94 | 3433.18 | 1.47 | 2.33 | 1.17 |
| Up | D233E | 443 | 2881.17 | 1918.57 | 1.50 | 1.33 | 0.65 |
| Up | I234A | 447 | 1458.10 | 1018.50 | 1.43 | 0.31 | 0.18 |
| Up | I234T | 446 | 1451.51 | 1188.67 | 1.22 | 0.31 | 0.21 |
| Up | I234E | 444 | 1301.06 | 840.09 | 1.55 | 0.27 | 0.15 |
| Up | I234Q | 445 | 1095.18 | 837.53 | 1.31 | 0.23 | 0.15 |
| Up | I237L | 518 | 2880.14 | 2240.61 | 1.29 | 0.61 | 0.39 |
| Down | I237W | 517 | 4188.38 | 5663.94 | 0.74 | 0.62 | 0.75 |
| Neutral | I237N | 516 | 5368.49 | 6271.59 | 0.86 | 0.80 | 0.83 |
| Up | I240S | 449 | 2033.91 | 1204.66 | 1.69 | 0.32 | 0.15 |
| Neutral | I240A | 450 | 2099.13 | 1776.41 | 1.18 | 0.33 | 0.23 |
| Up | I240C | 448 | 970.78 | 650.04 | 1.49 | 0.15 | 0.08 |
| Neutral | I251S | 519 | 8445.88 | 7160.96 | 1.18 | 1.07 | 0.96 |
| Neutral | I251W | 520 | 7305.95 | 6974.26 | 1.05 | 0.92 | 0.93 |
| Neutral | Q254S | 521 | 7768.13 | 8801.19 | 0.88 | 1.15 | 1.17 |
| Neutral | T255H | 522 | 8243.01 | 7352.60 | 1.12 | 1.22 | 0.98 |
| Neutral | P256C | 523 | 4674.45 | 4633.67 | 1.01 | 0.69 | 0.62 |
| Neutral | K257P | 525 | 8039.60 | 7464.88 | 1.08 | 1.19 | 0.99 |
| Neutral | K257T | 524 | 9346.88 | 8849.42 | 1.06 | 1.39 | 1.18 |
| Neutral | A258P | 526 | 10414.06 | 9178.82 | 1.13 | 1.55 | 1.22 |

TABLE 23

Reconfirmed HITs

| Temperature Phenotype | hMMP-1 mutation | SEQ ID NO |
|---|---|---|
| Up | L95K | 328 |
| Down | E100V | 457 |
| Neutral | T103Y | 458 |
| Up | D105A | 340 |
| Up | D105F | 336 |
| Up | D105G | 335 |
| Up | D105I | 338 |
| Up | D105L | 339 |
| Up | D105N | 332 |
| Up | D105R | 331 |
| Up | D105S | 334 |
| Up | D105T | 333 |
| Up | D105W | 337 |
| Up | R150P | 345 |
| Up | D151G | 346 |
| Neutral | S153T | 459 |
| Up | F155L | 347 |
| Up | F155A | 348 |
| Up | D156H | 349 |
| Up | D156L | 356 |
| Up | D156A | 357 |
| Up | D156W | 354 |
| Up | D156V | 355 |
| Up | D156K | 350 |
| Up | D156T | 352 |
| Up | D156R | 351 |
| Up | G159V | 363 |
| Up | G159T | 359 |
| Up | G171P | 462 |
| Up | A176F | 365 |
| Up | D179N | 368 |
| Up | E180Y | 374 |
| Neutral | E180R | 371 |
| Up | E180T | 373 |
| Up | E180F | 377 |
| Neutral | D181T | 380 |
| Up | D181L | 382 |
| Up | D181K | 378 |
| Up | E182T | 384 |
| Up | E182Q | 383 |
| Up | T185R | 390 |
| Up | T185Y | 392 |
| Up | T185H | 389 |
| Up | T185G | 393 |
| Up | T185V | 394 |
| Up | T185Q | 391 |
| Up | T185A | 395 |
| Up | T185E | 388 |
| Up | N187R | 398 |
| Up | N187M | 402 |
| Neutral | N187W | 403 |
| Up | N187F | 401 |

TABLE 23-continued

Reconfirmed HITs

| Temperature Phenotype | hMMP-1 mutation | SEQ ID NO |
|---|---|---|
| Up | N187K | 397 |
| Up | N187I | 404 |
| Up | N187A | 405 |
| Up | E190G | 465 |
| Up | Y191V | 466 |
| Up | N192H | 468 |
| Up | N192S | 470 |
| Up | N192D | 467 |
| Up | N192C | 469 |
| Neutral | H194P | 471 |
| Up | R195C | 407 |
| Neutral | R195W | 410 |
| Neutral | R195L | 412 |
| Up | R195G | 409 |
| Up | R195Q | 408 |
| Up | R195A | 413 |
| Up | R195D | 406 |
| Up | R195V | 411 |
| Neutral | A198G | 414 |
| Up | A198L | 416 |
| Up | A198M | 415 |
| Up | G206A | 418 |
| Up | G206S | 417 |
| Up | L207R | 472 |
| Up | S210V | 419 |
| Up | D212G | 477 |
| Up | Y218S | 421 |
| Up | F223C | 424 |
| Up | F223E | 422 |
| Up | F223G | 426 |
| Up | F223A | 428 |
| Up | F223S | 425 |
| Up | V227C | 433 |
| Up | V227D | 429 |
| Up | V227E | 430 |
| Up | V227L | 438 |
| Up | V227S | 435 |
| Up | V227W | 437 |
| Up | Q228P | 439 |
| Up | L229A | 442 |
| Up | L229T | 440 |
| Up | L229I | 441 |
| Up | A230V | 478 |
| Up | D233E | 443 |
| Up | I234A | 447 |
| Up | I234T | 446 |
| Up | I234E | 444 |
| Up | I234Q | 445 |
| Up | I237L | 518 |
| Up | I240S | 449 |
| Neutral | I240A | 450 |
| Up | I240C | 448 |

B. 14-mL Protein Expression

In this example, the hMMP-1 mutants that were identified as temperature sensitive primary hits in Example 28A were expressed in 14 ml culture tubes and their enzymatic activity was measured at 25° C., 34° C. and 37° C. for 1 hour, 2 hours or overnight in order to verify the desired phenotype of decreased activity at elevated temperatures. Protein was expressed and purified as in Example 27 with the exception that the expression was performed in 14 ml tubes rather than a 96-well plate.

Four (4) μl of each hMMP-1 mutant supernatant was transferred to a 96-well microplate. Supernatants were activated with APMA as described in Example 28A above, except that the solution was incubated at the reaction temperature of 25° C., 34° C., or 37° C. for 2 hours. As above, following activation, 100 μl of TCNB containing 10 μM Mca-K-P-L-G-L-Dpa-A-R-NH$_2$ (SEQ ID NO: 535; Mca=(7-Methoxycoumarin-4-yl)acetyl; Dpa=N-3-(2,4-Dinitrophenyl)-L-2,3-diaminopropionyl) fluorescent substrate was added to each tube at the indicated reaction temperature (25° C., 34° C. or 37° C.) for one hour. Wild-type hMMP-1 was used as a positive control and supernatant from cells transformed with the vector was used as a negative control. Fluorescence was detected by measuring fluorescence in a fluorescent plate reader at 320 nm exitation/405 nm emission. Relative fluorescence units (RFU) were determined. Duplicate reactions were performed for each sample, reaction temperature, and positive and negative control.

The data is shown in Table 24A (1 hour incubation); Table 24B (2 hour incubations) and Table 24C (overnight incubation), below. Mutants that were active at 25° C. but demonstrated at least a 33% decreased activity at 34° C. or 37° C. (i.e. had a ratio of activity at 25° C. and 34° C. or a ratio of activity of 25° C. and 37° C. equal to or greater than 1.5 under any of the time point conditions tested were identified as temperature sensitive Hits. Tables 24A-24C, below, list the hMMP-1 mutation, the RFU at 25° C., 34° C. and 37° C., and the ratio of the activities (at both 25° C./34° C. and 25° C./37° C.) of 64 hMMP-1 mutants whose decreased enzymatic activity at elevated temperatures were confirmed. Some of the hMMP-1 mutants, were noticeably more active at 25° C. than at an elevated temperature. For example, hMMP-1 mutant D179N (SEQ ID NO:368) was 87.5% more active at 25° C. than 37° C. after an overnight incubation (see e.g. Table 24C). Additionally, although expression levels, and therefore overall RFU values, varied in different experiments, the ratios of the activities remained the same. For example, mutant D156T was tested twice (see Table 24C below) and although each test gave different data RFU values the ratio of the values were similar and consistently within the 1.5 ratio parameter.

TABLE 24A

Temperature Sensitive hMMP-1 Mutants, 1 hour incubation

| hMMP-1 mutation | SEQ ID NO | RFU 25° C. | RFU 34° C. | RFU 37° C. | Ratio 25° C./34° C. | Ratio 25° C./37° C. |
|---|---|---|---|---|---|---|
| L95K | 328 | 2677.64 | 553.00 | 572.70 | 4.84 | 4.68 |
| D105A | 340 | 3496.48 | 697.79 | 1119.92 | 5.01 | 3.12 |
| D105F | 336 | 1749.85 | 554.69 | 685.49 | 3.15 | 2.55 |
| D105G | 335 | 7450.35 | 2196.32 | 3514.50 | 3.39 | 2.12 |
| D105I | 338 | 4720.96 | 638.42 | 943.44 | 7.39 | 5.00 |
| D105L | 339 | 2636.80 | 490.04 | 552.90 | 5.38 | 4.77 |
| D105N | 332 | 7487.95 | 776.33 | 1513.73 | 9.65 | 4.95 |
| D105R | 331 | 1732.70 | 641.23 | 736.92 | 2.70 | 2.35 |
| D105S | 334 | 8637.40 | 3782.36 | 6510.05 | 2.28 | 1.33 |
| D105W | 337 | 4263.51 | 1321.69 | 2422.77 | 3.23 | 1.76 |
| D105T | 333 | 2666.45 | 770.72 | 1685.33 | 3.46 | 1.58 |
| R150P | 345 | 7568.19 | 1678.59 | 2010.33 | 4.51 | 3.76 |
| D151G | 346 | 973.47 | 517.98 | 595.63 | 1.88 | 1.63 |
| F155A | 348 | 1800.92 | 592.07 | 596.31 | 3.04 | 3.02 |
| D156K | 350 | 8718.91 | 1733.90 | 1839.60 | 5.03 | 4.74 |
| D156T | 352 | 8034.06 | 2216.02 | 2255.25 | 3.63 | 3.56 |
| D156L | 356 | 1825.01 | 528.43 | 619.10 | 3.45 | 2.95 |
| D156A | 357 | 1495.21 | 450.17 | 496.04 | 3.32 | 3.01 |
| D156W | 354 | 1006.97 | 463.48 | 493.84 | 2.17 | 2.04 |
| D156V | 355 | 1140.60 | 484.30 | 504.38 | 2.36 | 2.26 |
| D156T | 352 | 2796.00 | 581.90 | 743.53 | 4.80 | 3.76 |
| D156H | 349 | 3489.60 | 578.59 | 711.59 | 6.03 | 4.90 |
| D156R | 351 | 4983.67 | 678.23 | 734.95 | 7.35 | 6.78 |
| G159V | 363 | 3416.77 | 705.80 | 739.87 | 4.84 | 4.62 |
| G159T | 359 | 4081.99 | 1732.63 | 1865.15 | 2.36 | 2.19 |
| A176F | 365 | 967.31 | 539.31 | 517.16 | 1.79 | 1.87 |
| D179N | 368 | 4105.85 | 492.00 | 513.37 | 8.35 | 8.00 |
| E180Y | 374 | 8803.90 | 3904.31 | 5268.18 | 2.25 | 1.67 |
| E180T | 373 | 5957.38 | 1155.89 | 1430.72 | 5.15 | 4.16 |
| E180F | 377 | 7484.41 | 2677.89 | 3141.69 | 2.79 | 2.38 |
| D181L | 382 | 1629.22 | 559.04 | 549.09 | 2.91 | 2.97 |

TABLE 24A-continued

Temperature Sensitive hMMP-1 Mutants, 1 hour incubation

| hMMP-1 mutation | SEQ ID NO | RFU 25° C. | RFU 34° C. | RFU 37° C. | Ratio 25° C./34° C. | Ratio 25° C./37° C. |
|---|---|---|---|---|---|---|
| D181K | 378 | 844.40 | 570.98 | 569.44 | 1.48 | 1.48 |
| E182T | 384 | 2244.96 | 653.93 | 668.01 | 3.43 | 3.36 |
| E182Q | 383 | 1066.68 | 583.87 | 582.84 | 1.83 | 1.83 |
| T185R | 390 | 1599.19 | 867.00 | 872.66 | 1.84 | 1.83 |
| T185H | 389 | 3616.30 | 1601.20 | 1842.01 | 2.26 | 1.96 |
| T185Q | 391 | 4365.21 | 1512.02 | 1899.46 | 2.89 | 2.30 |
| T185A | 395 | 1374.00 | 567.04 | 608.05 | 2.42 | 2.26 |
| T185E | 388 | 2145.28 | 1263.20 | 1399.76 | 1.70 | 1.53 |
| N187R | 398 | 1659.90 | 955.75 | 1054.91 | 1.74 | 1.57 |
| N187M | 402 | 2842.50 | 1343.95 | 1464.36 | 2.12 | 1.94 |
| N187F | 401 | 1846.10 | 716.62 | 786.07 | 2.58 | 2.35 |
| N187K | 397 | 2428.31 | 1703.73 | 1914.84 | 1.43 | 1.27 |
| N187I | 404 | 2455.44 | 717.51 | 773.59 | 3.42 | 3.17 |
| R195V | 411 | 3121.02 | 1947.80 | 2132.94 | 1.60 | 1.46 |
| A198L | 416 | 4547.61 | 1570.19 | 2061.87 | 2.90 | 2.21 |
| A198M | 415 | 1948.92 | 1101.86 | 1535.22 | 1.77 | 1.27 |
| G206A | 418 | 667.50 | 543.90 | 540.79 | 1.23 | 1.23 |
| G206S | 417 | 608.46 | 427.44 | 412.07 | 1.42 | 1.48 |
| S210V | 419 | 1952.12 | 961.54 | 1791.55 | 2.03 | 1.09 |
| Y218S | 421 | 1674.47 | 1531.03 | 1573.00 | 1.09 | 1.06 |
| F223E | 422 | 5837.16 | 2747.99 | 4955.08 | 2.12 | 1.18 |
| V227C | 433 | 1138.96 | 684.05 | 722.68 | 1.67 | 1.58 |
| V227E | 430 | 5892.76 | 653.81 | 803.12 | 9.01 | 7.34 |
| V227W | 437 | 716.50 | 607.92 | 646.75 | 1.18 | 1.11 |
| Q228P | 439 | 676.11 | 488.99 | 495.88 | 1.38 | 1.36 |
| L229T | 440 | 768.59 | 492.66 | 491.49 | 1.56 | 1.56 |
| L229I | 441 | 1470.04 | 753.87 | 1231.17 | 1.95 | 1.19 |
| D233E | 443 | 1195.07 | 959.25 | 1056.45 | 1.25 | 1.13 |
| I234A | 447 | 1402.15 | 1014.61 | 1127.63 | 1.38 | 1.24 |
| I234T | 446 | 857.79 | 644.52 | 712.49 | 1.33 | 1.20 |
| I234E | 444 | 2281.82 | 591.10 | 762.52 | 3.86 | 2.99 |
| I240S | 449 | 2678.36 | 776.88 | 1314.40 | 3.45 | 2.04 |
| I240C | 448 | 1540.91 | 474.82 | 666.63 | 3.25 | 2.31 |

TABLE 24B

Temperature Sensitive hMMP-1 Mutants, 2 hours incubation

| hMMP-1 mutation | SEQ ID NO | RFU 25° C. | RFU 34° C. | RFU 37° C. | Ratio 25° C./34° C. | Ratio 25° C./37° C. |
|---|---|---|---|---|---|---|
| L95K | 328 | 4650.42 | 748.29 | 746.89 | 6.21 | 6.23 |
| D105A | 340 | 5669.31 | 824.07 | 1336.14 | 6.88 | 4.24 |
| D105F | 336 | 2980.00 | 623.89 | 818.63 | 4.78 | 3.64 |
| D105G | 335 | 8821.81 | 2759.24 | 4313.40 | 3.20 | 2.05 |
| D105I | 338 | 6832.34 | 780.32 | 1110.07 | 8.76 | 6.15 |
| D105L | 339 | 4206.38 | 534.24 | 607.46 | 7.87 | 6.92 |
| D105N | 332 | 8920.05 | 918.13 | 1727.44 | 9.72 | 5.16 |
| D105R | 331 | 2821.20 | 722.46 | 813.68 | 3.90 | 3.47 |
| D105S | 334 | 9355.63 | 4607.18 | 7274.97 | 2.03 | 1.29 |
| D105W | 337 | 6663.80 | 1690.93 | 3081.59 | 3.94 | 2.16 |
| D105T | 333 | 4457.16 | 974.63 | 2220.03 | 4.57 | 2.01 |
| R150P | 345 | 8750.30 | 2315.11 | 2497.86 | 3.78 | 3.50 |
| D151G | 346 | 1264.62 | 589.27 | 616.51 | 2.15 | 2.05 |
| F155A | 348 | 2824.01 | 779.72 | 746.59 | 3.62 | 3.78 |
| D156K | 350 | 8576.47 | 2210.63 | 2310.30 | 3.88 | 3.71 |
| D156T | 352 | 8727.27 | 2679.17 | 2752.35 | 3.26 | 3.17 |
| D156L | 356 | 2916.24 | 576.84 | 688.08 | 5.06 | 4.24 |
| D156A | 357 | 2299.63 | 533.68 | 554.21 | 4.31 | 4.15 |
| D156W | 354 | 1502.86 | 539.74 | 575.12 | 2.78 | 2.61 |
| D156V | 355 | 1593.06 | 534.71 | 542.36 | 2.94 | 2.94 |
| D156T | 352 | 4469.68 | 690.87 | 848.14 | 6.47 | 5.27 |
| D156H | 349 | 5387.79 | 698.77 | 819.82 | 7.71 | 6.57 |
| D156R | 351 | 7020.81 | 793.83 | 872.40 | 8.84 | 8.05 |
| G159V | 363 | 4673.44 | 856.78 | 838.46 | 5.45 | 5.57 |
| G159T | 359 | 6704.95 | 2294.40 | 2347.74 | 2.92 | 2.86 |
| A176F | 365 | 1609.85 | 654.43 | 618.72 | 2.46 | 2.60 |
| D179N | 368 | 5660.69 | 644.51 | 656.31 | 8.78 | 8.63 |
| E180Y | 374 | 8557.09 | 4979.24 | 6079.36 | 1.72 | 1.41 |
| E180T | 373 | 7870.99 | 1532.35 | 1794.15 | 5.14 | 4.39 |

TABLE 24B-continued

Temperature Sensitive hMMP-1 Mutants, 2 hours incubation

| hMMP-1 mutation | SEQ ID NO | RFU 25° C. | RFU 34° C. | RFU 37° C. | Ratio 25° C./34° C. | Ratio 25° C./37° C. |
|---|---|---|---|---|---|---|
| E180F | 377 | 8508.13 | 3597.75 | 3975.22 | 2.36 | 2.14 |
| D181L | 382 | 2710.97 | 619.39 | 611.92 | 4.38 | 4.43 |
| D181K | 378 | 1130.63 | 625.01 | 608.68 | 1.81 | 1.86 |
| E182T | 384 | 3702.08 | 791.23 | 826.28 | 4.68 | 4.48 |
| E182Q | 383 | 1331.50 | 639.84 | 623.11 | 2.08 | 2.14 |
| T185R | 390 | 2637.31 | 1187.63 | 1183.37 | 2.22 | 2.23 |
| T185H | 389 | 5593.77 | 2278.26 | 2534.15 | 2.46 | 2.21 |
| T185Q | 391 | 7006.87 | 2250.58 | 2642.74 | 3.11 | 2.65 |
| T185A | 395 | 2474.96 | 663.82 | 707.09 | 3.73 | 3.50 |
| T185E | 388 | 3948.43 | 2088.15 | 2091.32 | 1.89 | 1.89 |
| N187R | 398 | 3006.08 | 1352.97 | 1421.87 | 2.22 | 2.11 |
| N187M | 402 | 4934.44 | 1811.35 | 1893.07 | 2.72 | 2.61 |
| N187F | 401 | 3227.96 | 877.21 | 931.04 | 3.68 | 3.47 |
| N187K | 397 | 4182.49 | 2425.34 | 2652.79 | 1.72 | 1.58 |
| N187I | 404 | 4218.55 | 849.11 | 887.80 | 4.97 | 4.75 |
| R195V | 411 | 4847.81 | 2724.92 | 2984.10 | 1.78 | 1.62 |
| A198L | 416 | 6756.76 | 2056.50 | 2642.76 | 3.29 | 2.56 |
| A198M | 415 | 3777.50 | 1708.61 | 2155.58 | 2.21 | 1.75 |
| G206A | 418 | 872.27 | 603.01 | 586.57 | 1.45 | 1.49 |
| G206S | 417 | 932.69 | 492.65 | 463.60 | 1.89 | 2.01 |
| S210V | 419 | 3349.95 | 1249.47 | 2314.86 | 2.68 | 1.45 |
| Y218S | 421 | 2878.50 | 2373.98 | 2350.27 | 1.21 | 1.22 |
| F223E | 422 | 8318.70 | 3685.68 | 6209.93 | 2.26 | 1.34 |
| V227C | 433 | 1998.67 | 950.01 | 992.19 | 2.10 | 2.01 |
| V227E | 430 | 7904.54 | 839.00 | 1015.12 | 9.42 | 7.79 |
| V227W | 437 | 996.55 | 729.20 | 787.87 | 1.37 | 1.26 |
| Q228P | 439 | 1082.56 | 607.78 | 586.63 | 1.78 | 1.85 |
| L229T | 440 | 1221.05 | 580.15 | 564.49 | 2.10 | 2.16 |
| L229I | 441 | 2790.27 | 1050.86 | 1803.44 | 2.66 | 1.55 |
| D233E | 443 | 2195.02 | 1393.95 | 1454.71 | 1.57 | 1.51 |
| I234A | 447 | 2375.42 | 1473.70 | 1594.08 | 1.61 | 1.49 |
| I234T | 446 | 1199.18 | 713.83 | 796.81 | 1.68 | 1.50 |
| I234E | 444 | 3920.02 | 705.86 | 923.57 | 5.55 | 4.24 |
| I240S | 449 | 3867.71 | 973.97 | 1575.05 | 3.97 | 2.46 |
| I240C | 448 | 2688.75 | 561.91 | 853.66 | 4.78 | 3.15 |

TABLE 24C

Temperature Sensitive hMMP-1 Mutants, Overnight incubation

| hMMP-1 mutation | SEQ ID NO | RFU 25° C. | RFU 34° C. | RFU 37° C. | Ratio 25° C./34° C. | Ratio 25° C./37° C. |
|---|---|---|---|---|---|---|
| L95K | 328 | 7744.34 | 1803.12 | 1677.96 | 4.29 | 4.62 |
| D105A | 340 | 8466.62 | 1302.84 | 1931.17 | 6.50 | 4.38 |
| D105F | 336 | 6725.59 | 938.60 | 1173.23 | 7.17 | 5.73 |
| D105G | 335 | 8940.06 | 3560.75 | 5390.32 | 2.51 | 1.66 |
| D105I | 338 | 8394.32 | 1614.57 | 1958.96 | 5.20 | 4.29 |
| D105L | 339 | 6546.78 | 957.95 | 1070.51 | 6.83 | 6.12 |
| D105N | 332 | 9119.04 | 1459.16 | 2347.74 | 6.25 | 3.88 |
| D105R | 331 | 5775.25 | 1407.06 | 1499.57 | 4.10 | 3.85 |
| D105S | 334 | 9300.85 | 5584.70 | 8234.95 | 1.67 | 1.13 |
| D105W | 337 | 8617.36 | 2851.22 | 4593.06 | 3.02 | 1.88 |
| D105T | 333 | 7910.47 | 1899.25 | 3292.01 | 4.17 | 2.40 |
| R150P | 345 | 9011.11 | 3533.16 | 3559.66 | 2.55 | 2.53 |
| D151G | 346 | 1956.65 | 959.80 | 1097.68 | 2.04 | 1.78 |
| F155A | 348 | 4891.89 | 2016.76 | 1843.51 | 2.43 | 2.65 |
| D156K | 350 | 8696.27 | 3968.92 | 3858.90 | 2.19 | 2.25 |
| D156T | 352 | 8972.20 | 3971.43 | 3854.84 | 2.26 | 2.33 |
| D156L | 356 | 5254.55 | 972.64 | 1232.94 | 5.40 | 4.26 |
| D156A | 357 | 3585.37 | 1098.25 | 1110.73 | 3.26 | 3.23 |
| D156W | 354 | 2570.24 | 1091.27 | 1206.22 | 2.36 | 2.13 |
| D156V | 355 | 2208.99 | 954.21 | 997.64 | 2.31 | 2.21 |
| D156T | 352 | 7229.28 | 1256.02 | 1540.11 | 5.76 | 4.69 |
| D156H | 349 | 7587.19 | 1451.49 | 1763.27 | 5.23 | 4.30 |
| D156R | 351 | 8622.23 | 1735.02 | 1846.71 | 4.97 | 4.67 |
| G159V | 363 | 6555.27 | 1821.53 | 1683.20 | 3.60 | 3.89 |
| G159T | 359 | 9105.95 | 3210.57 | 3160.07 | 2.84 | 2.88 |
| A176F | 365 | 4191.69 | 1414.21 | 1336.32 | 2.96 | 3.14 |
| D179N | 368 | 7317.57 | 1504.84 | 1485.28 | 4.86 | 4.93 |

TABLE 24C-continued

Temperature Sensitive hMMP-1 Mutants, Overnight incubation

| hMMP-1 mutation | SEQ ID NO | RFU 25° C. | RFU 34° C. | RFU 37° C. | Ratio 25° C./34° C. | Ratio 25° C./37° C. |
|---|---|---|---|---|---|---|
| E180Y | 374 | 9281.77 | 6080.89 | 6894.61 | 1.53 | 1.35 |
| E180T | 373 | 8475.04 | 2585.89 | 2809.15 | 3.28 | 3.02 |
| E180F | 377 | 9360.74 | 5183.25 | 5335.15 | 1.81 | 1.75 |
| D181L | 382 | 4534.34 | 1078.98 | 1000.80 | 4.20 | 4.53 |
| D181K | 378 | 1869.47 | 946.27 | 928.55 | 1.98 | 2.01 |
| E182T | 384 | 6752.25 | 1483.52 | 1496.55 | 4.55 | 4.51 |
| E182Q | 383 | 2212.75 | 1065.07 | 1035.24 | 2.08 | 2.14 |
| T185R | 390 | 6281.97 | 2425.71 | 2300.61 | 2.59 | 2.73 |
| T185H | 389 | 8531.85 | 3164.69 | 3515.59 | 2.70 | 2.43 |
| T185Q | 391 | 9044.23 | 3639.00 | 4012.93 | 2.49 | 2.25 |
| T185A | 395 | 6156.97 | 1110.68 | 1059.61 | 5.54 | 5.81 |
| T185E | 388 | 8479.18 | 3868.06 | 3892.33 | 2.19 | 2.18 |
| N187R | 398 | 7593.11 | 2415.63 | 2370.01 | 3.14 | 3.20 |
| N187M | 402 | 8605.76 | 2769.52 | 2720.28 | 3.11 | 3.16 |
| N187F | 401 | 7352.85 | 1612.23 | 1704.23 | 4.56 | 4.31 |
| N187K | 397 | 8667.36 | 3458.94 | 3709.62 | 2.51 | 2.34 |
| N187I | 404 | 8306.40 | 1459.25 | 1465.77 | 5.69 | 5.67 |
| R195V | 411 | 8634.05 | 4648.03 | 4960.91 | 1.86 | 1.74 |
| A198L | 416 | 8795.36 | 3469.36 | 4181.78 | 2.54 | 2.10 |
| A198M | 415 | 8352.73 | 3215.69 | 3637.79 | 2.60 | 2.30 |
| G206A | 418 | 2492.53 | 1038.14 | 974.96 | 2.40 | 2.56 |
| G206S | 417 | 2845.84 | 908.82 | 808.42 | 3.13 | 3.52 |
| S210V | 419 | 7104.17 | 2441.96 | 3939.90 | 2.91 | 1.80 |
| Y218S | 421 | 7740.61 | 4057.37 | 4093.29 | 1.91 | 1.89 |
| F223E | 422 | 9650.44 | 4849.58 | 7645.34 | 1.99 | 1.26 |
| V227C | 433 | 5833.84 | 2207.20 | 2432.82 | 2.64 | 2.40 |
| V227E | 430 | 8630.92 | 2283.07 | 2152.81 | 3.78 | 4.01 |
| V227W | 437 | 3070.92 | 1370.13 | 1456.45 | 2.24 | 2.11 |
| Q228P | 439 | 3673.33 | 1162.95 | 1081.32 | 3.16 | 3.40 |
| L229T | 440 | 3543.75 | 1103.34 | 1030.05 | 3.21 | 3.44 |
| L229I | 441 | 7333.92 | 1832.18 | 3268.93 | 4.00 | 2.24 |
| D233E | 443 | 6694.93 | 2570.71 | 2661.43 | 2.60 | 2.52 |
| I234A | 447 | 6250.56 | 3890.90 | 4043.80 | 1.61 | 1.55 |
| I234T | 446 | 3507.08 | 1099.58 | 1228.23 | 3.19 | 2.86 |
| I234E | 444 | 7541.73 | 1365.08 | 1901.96 | 5.52 | 3.97 |
| I240S | 449 | 4376.99 | 2108.15 | 2592.19 | 2.08 | 1.69 |
| I240C | 448 | 6170.51 | 1174.96 | 2223.23 | 5.25 | 2.78 |

Table 25 below depicts the residual activity (the ratio of hMMP-1 mutant RFU/wt hMMP-1 RFU) of the hMMP-1 mutants following overnight incubation with the fluorescent peptide. The activity of mutants at 25° C., 34° C., or 37° C. were compared to the activity of wild-type hMMP-1 at the respective temperatures. At 25° C., five hMMP-1 mutants (E180F, E180Y, D156T, D156K, R150P) were more active than wildtype hMMP-1 as indicated by a residual activity >1. At elevated temperatures, all of the hMMP-1 mutants exhibited an overall decrease in activity when compared to wildtype hMMP-1 at the same temperature, thus confirming the phenotype of the hMMP-1 mutants as temperature sensitive mutants.

TABLE 25

Residual Activity of hMMP-1 Temperature Sensitive Mutants, Overnight Incubation

| hMMP-1 mutation | SEQ ID NO | Residual Activity 25° C. | Residual Activity 34° C. | Residual Activity 37° C. |
|---|---|---|---|---|
| L95K | 328 | 0.80 | 0.20 | 0.20 |
| D105A | 340 | 0.93 | 0.15 | 0.22 |
| D105F | 336 | 0.74 | 0.11 | 0.13 |
| D105G | 335 | 0.99 | 0.42 | 0.60 |
| D105I | 338 | 0.93 | 0.19 | 0.22 |
| D105L | 339 | 0.72 | 0.11 | 0.12 |
| D105N | 332 | 1.01 | 0.17 | 0.26 |
| D105R | 331 | 0.64 | 0.16 | 0.17 |
| D105S | 334 | 1.03 | 0.65 | 0.92 |
| D105W | 337 | 0.95 | 0.33 | 0.51 |
| D105T | 333 | 0.87 | 0.22 | 0.37 |
| R150P | 345 | 0.99 | 0.41 | 0.44 |
| D151G | 346 | 0.22 | 0.11 | 0.12 |
| F155A | 348 | 0.51 | 0.22 | 0.22 |
| D156K | 350 | 0.97 | 0.46 | 0.46 |
| D156T | 352 | 1.00 | 0.46 | 0.46 |
| D156L | 356 | 0.58 | 0.11 | 0.14 |
| D156A | 357 | 0.40 | 0.13 | 0.12 |
| D156W | 354 | 0.28 | 0.13 | 0.14 |
| D156V | 355 | 0.24 | 0.11 | 0.11 |
| D156T | 352 | 0.80 | 0.15 | 0.17 |
| D156H | 349 | 0.84 | 0.17 | 0.20 |
| D156R | 351 | 0.95 | 0.20 | 0.21 |
| G159V | 363 | 0.73 | 0.21 | 0.20 |
| G159T | 359 | 1.00 | 0.37 | 0.39 |
| A176F | 365 | 0.43 | 0.16 | 0.16 |
| D179N | 368 | 0.81 | 0.17 | 0.18 |
| E180Y | 374 | 1.02 | 0.70 | 0.85 |
| E180T | 373 | 0.93 | 0.30 | 0.35 |
| E180F | 377 | 1.03 | 0.60 | 0.66 |
| D181L | 382 | 0.50 | 0.12 | 0.12 |
| D181K | 378 | 0.21 | 0.11 | 0.11 |
| E182T | 384 | 0.74 | 0.17 | 0.18 |
| E182Q | 383 | 0.24 | 0.12 | 0.13 |
| T185R | 390 | 0.69 | 0.28 | 0.28 |
| T185H | 389 | 0.94 | 0.37 | 0.43 |
| T185Q | 391 | 1.00 | 0.42 | 0.49 |
| T185A | 395 | 0.68 | 0.13 | 0.13 |
| T185E | 388 | 0.93 | 0.45 | 0.48 |
| N187R | 398 | 0.84 | 0.28 | 0.29 |
| N187M | 402 | 0.95 | 0.32 | 0.33 |
| N187F | 401 | 0.81 | 0.19 | 0.21 |
| N187K | 397 | 0.95 | 0.40 | 0.46 |
| N187I | 404 | 0.92 | 0.17 | 0.18 |
| R195V | 411 | 0.96 | 0.54 | 0.59 |
| A198L | 416 | 0.98 | 0.40 | 0.49 |
| A198M | 415 | 0.87 | 0.36 | 0.42 |
| G206A | 418 | 0.27 | 0.12 | 0.12 |
| G206S | 417 | 0.31 | 0.10 | 0.10 |
| S210V | 419 | 0.78 | 0.29 | 0.44 |
| Y218S | 421 | 0.85 | 0.47 | 0.50 |
| F223E | 422 | 1.07 | 0.57 | 0.86 |
| V227C | 433 | 0.64 | 0.26 | 0.27 |
| V227E | 430 | 0.95 | 0.27 | 0.24 |
| V227W | 437 | 0.34 | 0.16 | 0.16 |
| Q228P | 439 | 0.38 | 0.13 | 0.13 |
| L229T | 440 | 0.37 | 0.12 | 0.12 |
| L229I | 441 | 0.76 | 0.20 | 0.38 |
| D233E | 443 | 0.69 | 0.28 | 0.31 |
| I234A | 447 | 0.69 | 0.45 | 0.45 |
| I234T | 446 | 0.39 | 0.13 | 0.14 |
| I234E | 444 | 0.83 | 0.16 | 0.21 |
| I240S | 449 | 0.48 | 0.25 | 0.29 |
| I240C | 448 | 0.68 | 0.14 | 0.25 |

C. hMMP-1 Top Mutant Hits

Fourteen (14) positions were identified at top hit positions: 95, 105, 150, 156, 159, 179, 180, 182, 185, 187, 198, 227, 234 and 240. Twenty three (23) hMMP-1 mutants at 14 positions were selected as top hits based on two criteria, including: 1) the ratio of the activities (25° C. to 37° C. and 25° C. to 34° C.); and 2) the activity (in RFUs). All of the mutants listed in Table 26 below had an activity greater than 2000 and a ratio of 25° C. to 37° C. greater than 2. The eleven Hits identified with a ** are the Hits that ranked high for both the ratio or activities and the activity level, and were used to develop a combinatorial library as described in Example 29.

TABLE 26

Top Hits

| | | | |
|---|---|---|---|
| L95K** | D105I | D105N** | D105L |
| D105A | D105G | R150P** | D156R |
| D156H | D156K** | D156T** | G159V** |
| G159T | D179N** | E180T** | E180F |
| E182T | T185Q | N187I | A198L** |
| V227E** | I234E | I240S** | |

EXAMPLE 29

Combinatorial hMMP-1 Variant Library

In this example, a combinatorial hMMP-1 variant library was generated from the mutants selected in Example 28C and shown in Table 26 with a double asterix (**). Mutants at positions 182, 185 and 187 were excluded in the generation of the combinatorial library because of the importance of these positions for hMMP-1 catalytic activity. The library contained every possible combination of amino acid variants for each of the selected mutants. Table 27 depicts all mutant combinations contained in the library. The positions indicated are with respect to positons corresponding to amino acid residues of hMMP-1 set forth in SEQ ID NO:327. Each row and column indicates one polypeptide containing the noted mutations. For example, 156K 179N 227E, refers to a polypeptide containing three amino acid replacements at positions corresponding to positions set forth in SEQ ID NO:327: D by K at position 156, D by N at position 179 and V by E at position 227. The library was generated and expressed as described in Example 27.

TABLE 27

Combinatorial Library Mutants

| | | | |
|---|---|---|---|
| 95K | 150P 156T | 156K 179N 227E | 150P 156T 240S |
| 105N | 105N 240S | 156K 179N 198L | 150P 156T 227E |
| 150P | 105N 227E | 156K 179N 180T | 150P 156T 198L |
| 156K | 105N 198L | 156K 159V 240S | 150P 156T 180T |
| 156T | 105N 180T | 156K 159V 227E | 150P 156T 179N |
| 159V | 105N 179N | 156K 159V 198L | 150P 156T 159V |
| 179N | 105N 159V | 156K 159V 180T | 105N 227E 240S |
| 180T | 105N 156K | 156K 159V 179N | 105N 198L 240S |
| 198L | 105N 156T | 156T 227E 240S | 105N 198L 227E |
| 227E | 105N 150P | 156T 198L 240S | 105N 180T 240S |
| 240S | 95K 240S | 156T 198L 227E | 105N 180T 227E |
| 227E 240S | 95K 227E | 156T 180T 240S | 105N 180T 198L |
| 198L 240S | 95K 198L | 156T 180T 227E | 105N 179N 240S |
| 198L 227E | 95K 180T | 156T 180T 198L | 105N 179N 227E |
| 180T 240S | 95K 179N | 156T 179N 240S | 105N 179N 198L |
| 180T 227E | 95K 159V | 156T 179N 227E | 105N 179N 180T |
| 180T 198L | 95K 156T | 156T 179N 198L | 105N 159V 240S |
| 179N 240S | 95K 150P | 156T 179N 180T | 105N 159V 227E |
| 179N 227E | 95K 105N | 156T 159V 240S | 105N 159V 198L |
| 179N 198L | 95K 156K | 156T 159V 227E | 105N 159V 180T |
| 179N 180T | 180T 227E 240S | 156T 159V 198L | 105N 159V 179N |
| 159V 240S | 180T 198L 240S | 156T 159V 180T | 105N 156K 240S |
| 159V 227E | 180T 198L 227E | 156T 159V 179N | 105N 156K 227E |
| 159V 198L | 179N 227E 240S | 150P 227E 240S | 105N 156K 198L |
| 159V 180T | 179N 198L 240S | 198L 227E 240S | 105N 156K 180T |
| 159V 179N | 179N 198L 227E | 150P 198L 240S | 105N 156K 179N |
| 156K 240S | 179N 180T 240S | 150P 198L 227E | 105N 156K 159V |
| 156K 227E | 179N 180T 227E | 150P 180T 240S | 105N 156T 240S |
| 156K 198L | 179N 180T 198L | 150P 180T 227E | 105N 156T 227E |
| 156K 180T | 159V 227E 240S | 150P 180T 198L | 105N 156T 198L |
| 156K 179N | 159V 198L 240S | 150P 179N 240S | 105N 156T 180T |
| 156K 159V | 159V 198L 227E | 150P 179N 227E | 105N 156T 179N |
| 156T 240S | 159V 180T 240S | 150P 179N 198L | 105N 156T 159V |
| 156T 227E | 159V 180T 227E | 150P 179N 180T | 105N 150P 240S |
| 156T 198L | 159V 180T 198L | 150P 159V 240S | 105N 150P 227E |
| 156T 180T | 159V 179N 240S | 150P 159V 227E | 105N 150P 198L |
| 156T 179N | 159V 179N 227E | 150P 159V 198L | 105N 150P 180T |
| 156T 159V | 159V 179N 198L | 150P 159V 180T | 105N 150P 179N |
| 150P 240S | 159V 179N 180T | 150P 159V 179N | 105N 150P 159V |
| 150P 227E | 156K 227E 240S | 150P 156K 240S | 105N 150P 156K |
| 150P 198L | 156K 198L 240S | 150P 156K 227E | 105N 150P 156T |
| 150P 180T | 156K 198L 227E | 150P 156K 198L | 95K 227E 240S |
| 150P 179N | 156K 180T 240S | 150P 156K 180T | 95K 198L 240S |
| 150P 156K | 156K 180T 227E | 156K 180T 198L | 150P 156K 179N |
| 150P 159V | 156K 179N 240S | 150P 156K 159V | 95K 180T 240S |
| 95K 180T 227E | 179N 180T 198L 240S | 156T 159V 180T 198L | |
| 95K 180T 198L | 179N 180T 198L 227E | 156T 159V 179N 240S | |
| 95K 179N 240S | 159V 198L 227E 240S | 156T 159V 179N 227E | |
| 95K 179N 227E | 159V 180T 227E 240S | 156T 159V 179N 198L | |
| 95K 179N 198L | 159V 180T 198L 240S | 156T 159V 179N 180T | |
| 95K 179N 180T | 159V 180T 198L 227E | 150P 198L 227E 240S | |
| 95K 159V 240S | 159V 179N 227E 240S | 150P 180T 227E 240S | |
| 95K 159V 227E | 159V 179N 198L 240S | 150P 180T 198L 240S | |
| 95K 159V 198L | 159V 179N 198L 227E | 150P 180T 198L 227E | |
| 95K 159V 180T | 159V 179N 180T 240S | 150P 179N 227E 240S | |
| 95K 159V 179N | 159V 179N 180T 227E | 150P 179N 198L 240S | |

TABLE 27-continued

Combinatorial Library Mutants

| | | |
|---|---|---|
| 95K 156K 240S | 159V 179N 180T 198L | 150P 179N 198L 227E |
| 95K 156K 227E | 156K 198L 227E 240S | 150P 179N 180T 240S |
| 95K 156K 198L | 156K 180T 227E 240S | 150P 179N 180T 227E |
| 95K 156K 180T | 156K 180T 198L 240S | 150P 179N 180T 198L |
| 95K 156K 179N | 156K 180T 198L 227E | 150P 159V 227E 240S |
| 95K 156K 159V | 156K 179N 227E 240S | 150P 159V 198L 240S |
| 95K 198L 227E | 156K 179N 198L 240S | 150P 159V 198L 227E |
| 95K 156T 240S | 156K 179N 198L 227E | 150P 159V 180T 240S |
| 95K 156T 227E | 156K 179N 180T 240S | 150P 159V 180T 227E |
| 95K 156T 198L | 156K 179N 180T 227E | 150P 159V 180T 198L |
| 95K 156T 180T | 156K 179N 180T 198L | 150P 159V 179N 240S |
| 95K 156T 179N | 156K 159V 227E 240S | 150P 159V 179N 227E |
| 95K 156T 159V | 156K 159V 198L 240S | 150P 159V 179N 198L |
| 95K 150P 240S | 156K 159V 198L 227E | 150P 159V 179N 180T |
| 95K 150P 227E | 156K 159V 180T 240S | 150P 156K 227E 240S |
| 95K 150P 198L | 156K 159V 180T 227E | 150P 156K 198L 240S |
| 95K 150P 180T | 156K 159V 180T 198L | 150P 156K 198L 227E |
| 95K 150P 179N | 156K 159V 179N 240S | 150P 156K 180T 240S |
| 95K 150P 159V | 156K 159V 179N 227E | 150P 156K 180T 227E |
| 95K 150P 156K | 156K 159V 179N 198L | 150P 156K 180T 198L |
| 95K 150P 156T | 156K 159V 179N 180T | 150P 156K 179N 240S |
| 95K 105N 240S | 156T 198L 227E 240S | 150P 156K 179N 227E |
| 95K 105N 227E | 156T 180T 227E 240S | 150P 156K 179N 198L |
| 95K 105N 198L | 156T 180T 198L 240S | 150P 156K 179N 180T |
| 95K 105N 180T | 156T 180T 198L 227E | 150P 156K 159V 240S |
| 95K 105N 179N | 156T 179N 227E 240S | 150P 156K 159V 227E |
| 95K 105N 159V | 156T 179N 198L 240S | 156T 179N 180T 240S |
| 95K 105N 156K | 156T 179N 198L 227E | 156T 179N 180T 227E |
| 95K 105N 156T | 156T 159V 227E 240S | 156T 179N 180T 198L |
| 95K 105N 150P | 156T 159V 198L 240S | 150P 156T 227E 240S |
| 180T 198L 227E 240S | 156T 159V 198L 227E | 150P 156T 198L 240S |
| 179N 198L 227E 240S | 156T 159V 180T 240S | 150P 156T 198L 227E |
| 179N 180T 227E 240S | 156T 159V 180T 227E | 150P 156T 180T 240S |
| 150P 156T 180T 227E | 105N 156T 198L 240S | 95K 180T 198L 227E |
| 150P 156T 180T 198L | 105N 156T 180T 227E | 95K 179N 180T 227E |
| 150P 156T 179N 240S | 105N 156T 180T 198L | 95K 179N 180T 198L |
| 150P 156T 179N 227E | 105N 156T 179N 240S | 95K 159V 227E 240S |
| 150P 156T 179N 198L | 105N 156T 179N 227E | 95K 159V 198L 240S |
| 150P 156T 179N 180T | 105N 156T 179N 198L | 95K 159V 198L 227E |
| 150P 156T 159V 240S | 105N 156T 179N 180T | 95K 159V 180T 227E |
| 150P 156T 159V 227E | 105N 156T 159V 240S | 95K 159V 180T 198L |
| 150P 156T 159V 198L | 105N 156T 159V 227E | 95K 159V 179N 240S |
| 150P 156T 159V 180T | 105N 156T 159V 198L | 95K 159V 179N 227E |
| 150P 156T 159V 179N | 105N 156T 159V 180T | 95K 159V 179N 198L |
| 105N 198L 227E 240S | 105N 156T 159V 179N | 95K 159V 179N 180T |
| 105N 180T 227E 240S | 105N 150P 227E 240S | 95K 156K 227E 240S |
| 105N 180T 198L 240S | 105N 150P 198L 240S | 95K 156K 198L 240S |
| 105N 180T 198L 227E | 105N 150P 198L 227E | 95K 156K 198L 227E |
| 105N 179N 227E 240S | 105N 150P 180T 240S | 95K 156K 180T 240S |
| 105N 179N 198L 240S | 105N 150P 180T 227E | 95K 156K 180T 227E |
| 105N 179N 198L 227E | 105N 150P 180T 198L | 95K 156K 180T 198L |
| 105N 179N 180T 240S | 105N 150P 179N 240S | 95K 156K 179N 240S |
| 105N 179N 180T 227E | 105N 150P 179N 227E | 95K 156K 179N 227E |
| 105N 179N 180T 198L | 105N 150P 179N 198L | 95K 156K 179N 198L |
| 105N 159V 227E 240S | 105N 150P 179N 180T | 95K 156K 179N 180T |
| 105N 159V 198L 240S | 105N 150P 159V 240S | 95K 156K 159V 240S |
| 105N 159V 198L 227E | 105N 150P 159V 227E | 95K 156K 159V 227E |
| 105N 159V 180T 240S | 105N 150P 159V 198L | 95K 156K 159V 198L |
| 105N 159V 180T 227E | 105N 150P 159V 180T | 95K 156K 159V 180T |
| 105N 159V 180T 198L | 105N 150P 159V 179N | 95K 156K 159V 179N |
| 105N 159V 179N 240S | 105N 150P 156K 240S | 95K 156T 227E 240S |
| 105N 159V 179N 227E | 105N 150P 156K 227E | 95K 156T 198L 240S |
| 105N 159V 179N 198L | 105N 150P 156K 198L | 95K 156T 198L 227E |
| 105N 159V 179N 180T | 105N 150P 156K 180T | 95K 156T 180T 240S |
| 105N 156K 227E 240S | 105N 156K 180T 227E | 95K 156T 180T 240S |
| 105N 156K 198L 240S | 105N 156K 180T 198L | 105N 150P 156K 179N |
| 105N 156K 198L 227E | 105N 156K 179N 240S | 105N 150P 156K 159V |
| 105N 156K 180T 240S | 105N 156K 179N 227E | 105N 150P 156T 240S |
| 150P 156K 159V 198L | 105N 156K 179N 198L | 105N 150P 156T 227E |
| 150P 156K 159V 180T | 105N 156K 179N 180T | 105N 150P 156T 198L |
| 150P 156K 159V 179N | 105N 150P 156T 179N | 105N 150P 156T 180T |
| 105N 156K 159V 240S | 105N 150P 156T 159V | 95K 156T 179N 198L |
| 105N 156K 159V 227E | 95K 198L 227E 240S | 95K 156T 179N 180T |
| 105N 156K 159V 198L | 95K 180T 227E 240S | 95K 156T 159V 240S |
| 105N 156K 159V 180T | 95K 180T 198L 240S | 95K 156T 159V 227E |
| 105N 156K 159V 179N | 95K 179N 227E 240S | 95K 156T 159V 198L |
| 105N 156T 227E 240S | 95K 179N 198L 240S | 95K 156T 159V 180T |
| 105N 156T 198L 227E | 95K 179N 198L 227E | 95K 156T 159V 179N |

TABLE 27-continued

Combinatorial Library Mutants

| | | |
|---|---|---|
| 105N 156T 180T 240S | 95K 179N 180T 240S | 95K 150P 227E 240S |
| 95K 150P 198L 240S | 95K 105N 156K 179N | |
| 95K 150P 198L 227E | 95K 105N 156K 159V | |
| 95K 150P 180T 240S | 95K 105N 156T 240S | |
| 95K 150P 180T 227E | 95K 105N 156T 227E | |
| 95K 150P 180T 198L | 95K 105N 156T 198L | |
| 95K 150P 179N 240S | 95K 105N 156T 180T | |
| 95K 150P 179N 227E | 95K 105N 156T 179N | |
| 95K 150P 179N 198L | 95K 105N 156T 159V | |
| 95K 150P 179N 180T | 95K 105N 150P 240S | |
| 95K 150P 159V 240S | 95K 105N 150P 227E | |
| 95K 150P 159V 227E | 95K 105N 150P 198L | |
| 95K 150P 159V 198L | 95K 105N 150P 180T | |
| 95K 150P 159V 180T | 95K 105N 150P 179N | |
| 95K 150P 159V 179N | 95K 105N 150P 159V | |
| 95K 150P 156K 240S | 95K 105N 150P 156K | |
| 95K 150P 156K 227E | 95K 105N 150P 156T | |
| 95K 150P 156K 198L | 95K 105N 179N 227E | |
| 95K 150P 156K 180T | 95K 105N 179N 198L | |
| 95K 150P 156K 179N | 95K 105N 179N 180T | |
| 95K 150P 156K 159V | 95K 105N 159V 240S | |
| 95K 150P 156T 240S | 156K 159V 179N 198L 227E | |
| 95K 150P 156T 227E | 179N 180T 198L 227E 240S | |
| 95K 150P 156T 198L | 159V 180T 198L 227E 240S | |
| 95K 150P 156T 180T | 159V 179N 198L 227E 240S | |
| 95K 150P 156T 179N | 159V 179N 180T 227E 240S | |
| 95K 150P 156T 159V | 159V 179N 180T 198L 240S | |
| 95K 105N 227E 240S | 159V 179N 180T 198L 227E | |
| 95K 105N 198L 240S | 156K 180T 198L 227E 240S | |
| 95K 105N 198L 227E | 156K 179N 198L 227E 240S | |
| 95K 105N 180T 240S | 156K 179N 180T 227E 240S | |
| 95K 105N 180T 227E | 156K 179N 180T 198L 240S | |
| 95K 105N 180T 198L | 156K 179N 180T 198L 227E | |
| 95K 105N 179N 240S | 156K 159V 198L 227E 240S | |
| 95K 156T 180T 227E | 156K 159V 180T 227E 240S | |
| 95K 156T 180T 198L | 156K 159V 180T 198L 240S | |
| 95K 156T 179N 240S | 156K 159V 180T 198L 227E | |
| 95K 156T 179N 227E | 156K 159V 179N 227E 240S | |
| 95K 105N 159V 227E | 156K 159V 179N 198L 240S | |
| 95K 105N 159V 198L | 150P 156K 159V 198L 227E | |
| 95K 105N 159V 180T | 156K 159V 179N 180T 240S | |
| 95K 105N 159V 179N | 156K 159V 179N 180T 227E | |
| 95K 105N 156K 240S | 156K 159V 179N 180T 198L | |
| 95K 105N 156K 227E | 156T 180T 198L 227E 240S | |
| 95K 105N 156K 198L | 156T 179N 198L 227E 240S | |
| 95K 105N 156K 180T | 156T 179N 180T 227E 240S | |
| 156T 179N 180T 198L 240S | 150P 156K 159V 179N 180T | |
| 156T 179N 180T 198L 227E | 150P 156K 198L 227E 240S | |
| 156T 159V 198L 227E 240S | 150P 156T 180T 227E 240S | |
| 156T 159V 180T 227E 240S | 150P 156T 180T 198L 240S | |
| 156T 159V 180T 198L 240S | 150P 156T 180T 198L 227E | |
| 156T 159V 180T 198L 227E | 150P 156T 179N 227E 240S | |
| 156T 159V 179N 227E 240S | 150P 156T 179N 198L 240S | |
| 156T 159V 179N 198L 240S | 150P 156T 179N 198L 227E | |
| 156T 159V 179N 198L 227E | 150P 156T 179N 180T 240S | |
| 156T 159V 179N 180T 240S | 150P 156T 179N 180T 227E | |
| 156T 159V 179N 180T 227E | 150P 156T 179N 180T 198L | |
| 156T 159V 179N 180T 198L | 150P 156T 159V 227E 240S | |
| 150P 180T 198L 227E 240S | 150P 156T 159V 198L 240S | |
| 150P 179N 198L 227E 240S | 150P 156T 159V 198L 227E | |
| 150P 179N 180T 227E 240S | 150P 156T 159V 180T 240S | |
| 150P 179N 180T 198L 240S | 150P 156T 159V 180T 227E | |
| 150P 179N 180T 198L 227E | 150P 156T 159V 180T 198L | |
| 150P 159V 198L 227E 240S | 150P 156T 159V 179N 240S | |
| 150P 159V 180T 227E 240S | 150P 156T 159V 179N 227E | |
| 150P 159V 180T 198L 240S | 150P 159V 180T 198L 227E | |
| 150P 159V 179N 227E 240S | 150P 156T 159V 179N 180T | |
| 150P 159V 179N 198L 240S | 105N 180T 198L 227E 240S | |
| 150P 159V 179N 198L 227E | 105N 179N 198L 227E 240S | |
| 150P 159V 179N 180T 240S | 105N 179N 180T 227E 240S | |
| 150P 159V 179N 180T 227E | 105N 179N 180T 198L 240S | |
| 150P 159V 179N 180T 198L | 105N 179N 180T 198L 227E | |
| 150P 156K 198L 227E 240S | 105N 159V 198L 227E 240S | |
| 150P 156K 180T 227E 240S | 105N 159V 180T 227E 240S | |
| 150P 156K 180T 198L 240S | 105N 159V 180T 198L 240S | |
| 150P 156K 180T 198L 227E | 105N 159V 180T 198L 227E | |
| 150P 156K 179N 227E 240S | 105N 159V 179N 227E 240S | |
| 150P 156K 179N 198L 240S | 105N 159V 179N 198L 240S | |

TABLE 27-continued

| Combinatorial Library Mutants | |
|---|---|
| 150P 156K 179N 198L 227E | 105N 159V 179N 198L 227E |
| 150P 156K 179N 180T 240S | 105N 159V 179N 180T 240S |
| 150P 156K 179N 180T 227E | 105N 159V 179N 180T 227E |
| 150P 156K 179N 180T 198L | 105N 159V 179N 180T 198L |
| 150P 156K 159V 227E 240S | 105N 156K 198L 227E 240S |
| 150P 156K 159V 198L 240S | 105N 156K 180T 227E 240S |
| 105N 156K 180T 198L 240S | 105N 150P 179N 180T 240S |
| 150P 156K 159V 180T 240S | 105N 156K 180T 198L 227E |
| 150P 156K 159V 180T 227E | 105N 156K 179N 227E 240S |
| 150P 156K 159V 180T 198L | 105N 156K 179N 198L 240S |
| 150P 156K 159V 179N 240S | 105N 156K 179N 198L 227E |
| 150P 156K 159V 179N 227E | 105N 156K 179N 180T 240S |
| 150P 156K 159V 179N 198L | 105N 156K 179N 180T 227E |
| 105N 156K 179N 180T 198L | 105N 150P 159V 180T 227E |
| 105N 156K 159V 227E 240S | 105N 150P 159V 180T 198L |
| 105N 156K 159V 198L 240S | 105N 150P 159V 179N 240S |
| 105N 156K 159V 198L 227E | 105N 150P 159V 179N 227E |
| 105N 156K 159V 180T 240S | 105N 150P 159V 179N 198L |
| 105N 156K 159V 180T 227E | 105N 150P 159V 179N 180T |
| 105N 156K 159V 180T 198L | 105N 150P 156K 227E 240S |
| 105N 156K 159V 179N 240S | 105N 150P 156K 198L 240S |
| 105N 156K 159V 179N 227E | 105N 150P 156K 198L 227E |
| 105N 156K 159V 179N 198L | 105N 150P 156K 180T 240S |
| 105N 156K 159V 179N 180T | 105N 150P 156K 180T 227E |
| 105N 156T 198L 227E 240S | 105N 150P 156K 180T 198L |
| 105N 156T 180T 227E 240S | 105N 150P 156K 179N 240S |
| 105N 156T 180T 198L 240S | 105N 150P 156K 179N 227E |
| 105N 156T 180T 198L 227E | 105N 150P 156K 179N 198L |
| 105N 156T 179N 227E 240S | 105N 150P 156K 179N 180T |
| 105N 156T 179N 198L 240S | 105N 150P 156K 159V 240S |
| 105N 156T 179N 198L 227E | 105N 150P 156K 159V 227E |
| 105N 156T 179N 180T 240S | 105N 150P 156K 159V 198L |
| 150P 156T 159V 179N 198L | 105N 156T 179N 180T 227E |
| 105N 156T 179N 180T 198L | 105N 150P 156K 159V 179N |
| 105N 156T 159V 227E 240S | 105N 150P 156T 227E 240S |
| 105N 156T 159V 198L 240S | 105N 150P 156T 198L 240S |
| 105N 156T 159V 198L 227E | 105N 150P 156T 198L 227E |
| 105N 156T 159V 180T 240S | 105N 150P 156T 180T 240S |
| 105N 156T 159V 180T 227E | 105N 150P 156T 180T 227E |
| 105N 156T 159V 180T 198L | 105N 150P 156T 180T 198L |
| 105N 156T 159V 179N 240S | 105N 150P 156T 179N 240S |
| 105N 156T 159V 179N 227E | 105N 150P 156T 179N 227E |
| 105N 156T 159V 179N 198L | 105N 150P 156T 179N 198L |
| 105N 156T 159V 179N 180T | 105N 150P 156T 179N 180T |
| 105N 150P 198L 227E 240S | 105N 150P 156T 159V 240S |
| 105N 150P 180T 227E 240S | 105N 150P 156T 159V 227E |
| 105N 150P 180T 198L 240S | 105N 150P 156T 159V 198L |
| 105N 150P 180T 198L 227E | 105N 150P 156T 159V 180T |
| 105N 150P 179N 227E 240S | 105N 150P 156T 159V 179N |
| 105N 150P 179N 198L 240S | 95K 180T 198L 227E 240S |
| 105N 150P 179N 198L 227E | 95K 179N 198L 227E 240S |
| 95K 179N 180T 227E 240S | 95K 156T 159V 198L 227E |
| 105N 150P 179N 180T 227E | 95K 179N 180T 198L 240S |
| 105N 150P 179N 180T 198L | 95K 179N 180T 198L 227E |
| 105N 150P 159V 227E 240S | 95K 159V 198L 227E 240S |
| 105N 150P 159V 198L 240S | 95K 159V 180T 227E 240S |
| 105N 150P 159V 198L 227E | 95K 159V 180T 198L 240S |
| 105N 150P 159V 180T 240S | 95K 159V 180T 198L 227E |
| 95K 159V 179N 227E 240S | 95K 156T 159V 179N 180T |
| 95K 159V 179N 198L 240S | 95K 150P 198L 227E 240S |
| 95K 159V 179N 198L 227E | 95K 150P 180T 227E 240S |
| 95K 159V 179N 180T 240S | 95K 150P 180T 198L 240S |
| 95K 159V 179N 180T 227E | 95K 150P 180T 198L 227E |
| 95K 159V 179N 180T 198L | 95K 150P 179N 227E 240S |
| 95K 156K 198L 227E 240S | 95K 150P 179N 198L 240S |
| 95K 156K 180T 227E 240S | 95K 150P 179N 198L 227E |
| 95K 156K 180T 198L 240S | 95K 150P 179N 180T 240S |
| 95K 156K 180T 198L 227E | 95K 150P 179N 180T 227E |
| 95K 156K 179N 227E 240S | 95K 150P 179N 180T 198L |
| 95K 156K 179N 198L 240S | 95K 150P 159V 227E 240S |
| 95K 156K 179N 198L 227E | 95K 150P 159V 198L 240S |
| 95K 156K 179N 180T 240S | 95K 150P 159V 198L 227E |
| 95K 156K 179N 180T 227E | 95K 150P 159V 180T 240S |
| 95K 156K 179N 180T 198L | 95K 150P 159V 180T 227E |
| 95K 156K 159V 227E 240S | 95K 150P 159V 180T 198L |
| 95K 156K 159V 198L 240S | 95K 150P 159V 179N 240S |
| 95K 156K 159V 198L 227E | 95K 150P 159V 179N 227E |
| 105N 150P 156K 159V 180T | 95K 156K 159V 180T 240S |

TABLE 27-continued

| Combinatorial Library Mutants | |
|---|---|
| 95K 156K 159V 180T 227E | 95K 150P 159V 179N 180T |
| 95K 156K 159V 180T 198L | 95K 150P 156K 227E 240S |
| 95K 156K 159V 179N 240S | 95K 150P 156K 198L 240S |
| 95K 156K 159V 179N 227E | 95K 150P 156K 198L 227E |
| 95K 156K 159V 179N 198L | 95K 150P 156K 180T 240S |
| 95K 156K 159V 179N 180T | 95K 150P 156K 180T 227E |
| 95K 156T 198L 227E 240S | 95K 150P 156K 180T 198L |
| 95K 156T 180T 227E 240S | 95K 150P 156K 179N 240S |
| 95K 156T 180T 198L 240S | 95K 150P 156K 179N 227E |
| 95K 156T 180T 198L 227E | 95K 150P 156K 179N 198L |
| 95K 156T 179N 227E 240S | 95K 150P 156K 179N 180T |
| 95K 156T 179N 198L 240S | 95K 150P 156K 159V 240S |
| 95K 156T 179N 198L 227E | 95K 150P 156K 159V 227E |
| 95K 156T 179N 180T 240S | 95K 150P 156K 159V 198L |
| 95K 156T 179N 180T 227E | 95K 150P 156K 159V 180T |
| 95K 156T 179N 180T 198L | 95K 150P 156K 159V 179N |
| 95K 156T 159V 227E 240S | 95K 150P 156T 227E 240S |
| 95K 156T 159V 198L 240S | 95K 150P 156T 198L 240S |
| 95K 150P 156T 198L 227E | 95K 105N 156K 159V 198L |
| 95K 156T 159V 180T 240S | 95K 150P 156T 180T 240S |
| 95K 156T 159V 180T 227E | 95K 150P 156T 180T 227E |
| 95K 156T 159V 180T 198L | 95K 150P 156T 180T 198L |
| 95K 156T 159V 179N 240S | 95K 150P 156T 179N 240S |
| 95K 156T 159V 179N 227E | 95K 150P 156T 179N 227E |
| 95K 156T 159V 179N 198L | 95K 150P 156T 179N 198L |
| 95K 150P 156T 179N 180T | 95K 105N 156T 180T 227E |
| 95K 150P 156T 159V 240S | 95K 105N 156T 180T 198L |
| 95K 150P 156T 159V 227E | 95K 105N 156T 179N 240S |
| 95K 150P 156T 159V 198L | 95K 105N 156T 179N 227E |
| 95K 150P 156T 159V 180T | 95K 105N 156T 179N 198L |
| 95K 150P 156T 159V 179N | 95K 105N 156T 179N 180T |
| 95K 105N 198L 227E 240S | 95K 105N 156T 159V 240S |
| 95K 105N 180T 227E 240S | 95K 105N 156T 159V 227E |
| 95K 105N 180T 198L 240S | 95K 105N 156T 159V 198L |
| 95K 105N 180T 198L 227E | 95K 105N 156T 159V 180T |
| 95K 105N 179N 227E 240S | 95K 105N 156T 159V 179N |
| 95K 105N 179N 198L 240S | 95K 105N 150P 227E 240S |
| 95K 105N 179N 198L 227E | 95K 105N 150P 198L 240S |
| 95K 105N 179N 180T 240S | 95K 105N 150P 198L 227E |
| 95K 105N 179N 180T 227E | 95K 105N 150P 180T 240S |
| 95K 105N 179N 180T 198L | 95K 105N 150P 180T 227E |
| 95K 105N 159V 227E 240S | 95K 105N 150P 180T 198L |
| 95K 105N 159V 198L 240S | 95K 105N 150P 179N 240S |
| 95K 105N 159V 198L 227E | 95K 105N 150P 179N 227E |
| 95K 150P 159V 179N 198L | 95K 105N 159V 180T 240S |
| 95K 105N 159V 180T 227E | 95K 105N 150P 179N 180T |
| 95K 105N 159V 180T 198L | 95K 105N 150P 159V 240S |
| 95K 105N 159V 179N 240S | 95K 105N 150P 159V 227E |
| 95K 105N 159V 179N 227E | 95K 105N 150P 159V 198L |
| 95K 105N 159V 179N 198L | 95K 105N 150P 159V 180T |
| 95K 105N 159V 179N 180T | 95K 105N 150P 159V 179N |
| 95K 105N 156K 227E 240S | 95K 105N 150P 156K 240S |
| 95K 105N 156K 198L 240S | 95K 105N 150P 156K 227E |
| 95K 105N 156K 198L 227E | 95K 105N 150P 156K 198L |
| 95K 105N 156K 180T 240S | 95K 105N 150P 156K 180T |
| 95K 105N 156K 180T 227E | 95K 105N 150P 156K 179N |
| 95K 105N 156K 180T 198L | 95K 105N 150P 156K 159V |
| 95K 105N 156K 179N 240S | 95K 105N 150P 156T 240S |
| 95K 105N 156K 179N 227E | 95K 105N 150P 156T 227E |
| 95K 105N 156K 179N 198L | 95K 105N 150P 156T 198L |
| 95K 105N 156K 179N 180T | 95K 105N 150P 156T 180T |
| 95K 105N 156K 159V 240S | 95K 105N 150P 156T 179N |
| 95K 105N 156K 159V 227E | 95K 105N 150P 156T 159V |
| 95K 105N 150P 179N 198L | 150P 156T 159V 179N 198L 240S |
| 95K 105N 156K 159V 180T | 159V 179N 180T 198L 227E 240S |
| 95K 105N 156K 159V 179N | 156K 179N 180T 198L 227E 240S |
| 95K 105N 156T 227E 240S | 156K 159V 180T 198L 227E 240S |
| 95K 105N 156T 198L 240S | 156K 159V 179N 198L 227E 240S |
| 95K 105N 156T 198L 227E | 156K 159V 179N 180T 227E 240S |
| 95K 105N 156T 180T 240S | 156K 159V 179N 180T 198L 240S |
| 150P 156T 159V 179N 198L 227E | 105N 159V 179N 198L 227E 240S |
| 150P 156T 159V 179N 180T 240S | 105N 159V 179N 180T 227E 240S |
| 150P 156T 159V 179N 180T 227E | 105N 159V 179N 180T 198L 240S |
| 150P 156T 159V 179N 180T 198L | 105N 159V 179N 180T 198L 227E |
| 105N 179N 180T 198L 227E 240S | 105N 156K 180T 198L 227E 240S |
| 105N 159V 180T 198L 227E 240S | 105N 156K 179N 198L 227E 240S |
| 156K 159V 179N 180T 198L 227E | 105N 156K 179N 180T 227E 240S |
| 156T 179N 180T 198L 227E 240S | 105N 156K 179N 180T 198L 240S |

TABLE 27-continued

| Combinatorial Library Mutants | |
|---|---|
| 156T 159V 180T 198L 227E 240S | 105N 156K 179N 180T 198L 227E |
| 156T 159V 179N 198L 227E 240S | 105N 156K 159V 198L 227E 240S |
| 156T 159V 179N 180T 227E 240S | 105N 156K 159V 180T 227E 240S |
| 156T 159V 179N 180T 198L 240S | 105N 156K 159V 180T 198L 240S |
| 156T 159V 179N 180T 198L 227E | 105N 156K 159V 180T 198L 227E |
| 150P 179N 180T 198L 227E 240S | 105N 156K 159V 179N 227E 240S |
| 150P 159V 180T 198L 227E 240S | 105N 156K 159V 179N 198L 240S |
| 150P 159V 179N 198L 227E 240S | 105N 156K 159V 179N 198L 227E |
| 150P 159V 179N 180T 227E 240S | 105N 156K 159V 179N 180T 240S |
| 150P 159V 179N 180T 198L 240S | 105N 156K 159V 179N 180T 227E |
| 150P 159V 179N 180T 198L 227E | 105N 156K 159V 179N 180T 198L |
| 150P 156K 180T 198L 227E 240S | 105N 156T 180T 198L 227E 240S |
| 150P 156K 179N 198L 227E 240S | 105N 156T 179N 198L 227E 240S |
| 150P 156K 179N 180T 227E 240S | 105N 156T 179N 180T 227E 240S |
| 150P 156K 179N 180T 198L 240S | 105N 156T 179N 180T 198L 240S |
| 150P 156K 179N 180T 198L 227E | 105N 156T 179N 180T 198L 227E |
| 150P 156K 159V 198L 227E 240S | 105N 156T 159V 198L 227E 240S |
| 150P 156K 159V 180T 227E 240S | 105N 156T 159V 180T 227E 240S |
| 150P 156K 159V 180T 198L 240S | 105N 156T 159V 180T 198L 240S |
| 150P 156K 159V 180T 198L 227E | 105N 156T 159V 180T 198L 227E |
| 150P 156K 159V 179N 227E 240S | 105N 156T 159V 179N 227E 240S |
| 150P 156K 159V 179N 198L 240S | 105N 156T 159V 179N 198L 240S |
| 150P 156K 159V 179N 198L 227E | 105N 156T 159V 179N 198L 227E |
| 150P 156K 159V 179N 180T 240S | 105N 156T 159V 179N 180T 240S |
| 150P 156K 159V 179N 180T 227E | 105N 156T 159V 179N 180T 227E |
| 150P 156K 159V 179N 180T 198L | 105N 156T 159V 179N 180T 198L |
| 150P 156T 180T 198L 227E 240S | 105N 150P 180T 198L 227E 240S |
| 150P 156T 179N 198L 227E 240S | 105N 150P 179N 198L 227E 240S |
| 150P 156T 179N 180T 227E 240S | 105N 150P 179N 180T 227E 240S |
| 150P 156T 179N 180T 198L 240S | 105N 150P 179N 180T 198L 240S |
| 150P 156T 179N 180T 198L 227E | 105N 150P 156T 159V 180T 227E |
| 150P 156T 159V 198L 227E 240S | 105N 150P 159V 179N 227E 240S |
| 150P 156T 159V 180T 227E 240S | 105N 150P 159V 179N 198L 240S |
| 150P 156T 159V 180T 198L 240S | 105N 150P 159V 179N 198L 227E |
| 150P 156T 159V 180T 198L 227E | 105N 150P 159V 179N 180T 240S |
| 150P 156T 159V 179N 227E 240S | 105N 150P 159V 179N 180T 227E |
| 105N 150P 179N 180T 198L 227E | 105N 150P 159V 179N 180T 198L |
| 105N 150P 156K 198L 227E 240S | 95K 159V 180T 198L 227E 240S |
| 105N 150P 156K 180T 227E 240S | 95K 159V 179N 198L 227E 240S |
| 105N 150P 156K 180T 198L 240S | 95K 159V 179N 180T 227E 240S |
| 105N 150P 156K 180T 198L 227E | 95K 159V 179N 180T 198L 240S |
| 105N 150P 156K 179N 227E 240S | 95K 159V 179N 180T 198L 227E |
| 105N 150P 156K 179N 198L 240S | 95K 156K 180T 198L 227E 240S |
| 105N 150P 156K 179N 198L 227E | 95K 156K 179N 198L 227E 240S |
| 105N 150P 156K 179N 180T 240S | 95K 156K 179N 180T 227E 240S |
| 105N 150P 156K 179N 180T 227E | 95K 156K 179N 180T 198L 240S |
| 105N 150P 156K 179N 180T 198L | 95K 156K 179N 180T 198L 227E |
| 105N 150P 156K 159V 227E 240S | 95K 156K 159V 198L 227E 240S |
| 105N 150P 156K 159V 198L 240S | 95K 156K 159V 180T 227E 240S |
| 105N 150P 156K 159V 198L 227E | 95K 156K 159V 180T 198L 240S |
| 105N 150P 156K 159V 180T 240S | 95K 156K 159V 180T 198L 227E |
| 105N 150P 156K 159V 180T 227E | 95K 156K 159V 179N 227E 240S |
| 105N 150P 156K 159V 180T 198L | 95K 156K 159V 179N 198L 240S |
| 105N 150P 156K 159V 179N 240S | 95K 156K 159V 179N 198L 227E |
| 105N 150P 156K 159V 179N 227E | 95K 156K 159V 179N 180T 240S |
| 105N 150P 156K 159V 179N 198L | 95K 156K 159V 179N 180T 227E |
| 105N 150P 156K 159V 179N 180T | 95K 156K 159V 179N 180T 198L |
| 105N 150P 159V 198L 227E 240S | 95K 156T 180T 198L 227E 240S |
| 105N 150P 159V 180T 227E 240S | 95K 156T 179N 198L 227E 240S |
| 105N 150P 159V 180T 198L 240S | 95K 156T 179N 180T 227E 240S |
| 105N 150P 159V 180T 198L 227E | 95K 156T 179N 180T 198L 240S |
| 105N 150P 156T 198L 227E 240S | 95K 156T 179N 180T 198L 227E |
| 105N 150P 156T 180T 227E 240S | 95K 156T 159V 198L 227E 240S |
| 105N 150P 156T 180T 198L 240S | 95K 156T 159V 180T 227E 240S |
| 105N 150P 156T 180T 198L 227E | 95K 156T 159V 180T 198L 240S |
| 105N 150P 156T 179N 227E 240S | 95K 156T 159V 180T 198L 227E |
| 105N 150P 156T 179N 198L 240S | 95K 156T 159V 179N 227E 240S |
| 105N 150P 156T 179N 198L 227E | 95K 156T 159V 179N 198L 240S |
| 105N 150P 156T 179N 180T 240S | 95K 156T 159V 179N 198L 227E |
| 105N 150P 156T 179N 180T 227E | 95K 156T 159V 179N 180T 240S |
| 105N 150P 156T 179N 180T 198L | 95K 156T 159V 179N 180T 227E |
| 105N 150P 156T 159V 227E 240S | 95K 156T 159V 179N 180T 198L |
| 105N 150P 156T 159V 198L 240S | 95K 150P 180T 198L 227E 240S |
| 105N 150P 156T 159V 198L 227E | 95K 150P 179N 198L 227E 240S |
| 105N 150P 156T 159V 180T 240S | 95K 150P 179N 180T 227E 240S |
| 95K 150P 179N 180T 198L 240S | 95K 150P 156T 159V 180T 240S |
| 105N 150P 156T 159V 180T 198L | 95K 150P 179N 180T 198L 227E |
| 105N 150P 156T 159V 179N 240S | 95K 150P 159V 198L 227E 240S |

TABLE 27-continued

Combinatorial Library Mutants 105N 150P 156T 159V 179N 227E
105N 150P 156T 159V 179N 198L
105N 150P 156T 159V 179N 180T
95K 179N 180T 198L 227E 240S
95K 150P 159V 179N 198L 240S
95K 150P 159V 179N 198L 227E
95K 150P 159V 179N 180T 240S
95K 150P 159V 179N 180T 227E
95K 150P 159V 179N 180T 198L
95K 150P 156K 198L 227E 240S
95K 150P 156K 180T 227E 240S
95K 150P 156K 180T 198L 240S
95K 150P 156K 180T 198L 227E
95K 150P 156K 179N 227E 240S
95K 150P 156K 179N 198L 240S
95K 150P 156K 179N 198L 227E
95K 150P 156K 179N 180T 240S
95K 150P 156K 179N 180T 227E
95K 150P 156K 179N 180T 198L
95K 150P 156K 159V 227E 240S
95K 150P 156K 159V 198L 240S
95K 150P 156K 159V 198L 227E
95K 150P 156K 159V 180T 240S
95K 150P 156K 159V 180T 227E
95K 150P 156K 159V 180T 198L
95K 150P 156K 159V 179N 240S
95K 150P 156K 159V 179N 227E
95K 150P 156K 159V 179N 198L
95K 150P 156K 159V 179N 180T
95K 150P 156T 198L 227E 240S
95K 150P 156T 180T 227E 240S
95K 150P 156T 180T 198L 240S
95K 150P 156T 180T 198L 227E
95K 150P 156T 179N 227E 240S
95K 150P 156T 179N 198L 240S
95K 150P 156T 179N 198L 227E
95K 150P 156T 179N 180T 240S
95K 150P 156T 179N 180T 227E
95K 150P 156T 179N 180T 198L
95K 150P 156T 159V 227E 240S
95K 150P 156T 159V 198L 240S
95K 150P 156T 159V 198L 227E
95K 150P 156T 159V 180T 227E
95K 150P 156T 159V 180T 198L
95K 150P 156T 159V 179N 240S
95K 150P 156T 159V 179N 227E
95K 150P 156T 159V 179N 198L
95K 150P 156T 159V 179N 180T
95K 105N 180T 198L 227E 240S
95K 105N 156T 159V 198L 227E
95K 105N 156T 159V 180T 240S
95K 105N 156T 159V 180T 227E
95K 105N 156T 159V 180T 198L
95K 105N 156T 159V 179N 240S
95K 105N 156T 159V 179N 227E
95K 105N 156T 159V 179N 198L
95K 105N 156T 159V 179N 180T
95K 105N 150P 198L 227E 240S
95K 105N 150P 180T 227E 240S
95K 105N 150P 180T 198L 240S
95K 105N 150P 180T 198L 227E
95K 105N 150P 179N 227E 240S
95K 105N 150P 179N 198L 240S
95K 105N 150P 179N 198L 227E
95K 105N 150P 179N 180T 240S
95K 105N 150P 179N 180T 227E
95K 105N 150P 179N 180T 198L
95K 105N 150P 159V 227E 240S
95K 105N 150P 159V 198L 240S
95K 105N 150P 159V 198L 227E
95K 105N 150P 159V 180T 240S
95K 105N 150P 159V 180T 227E
95K 105N 150P 159V 180T 198L
95K 105N 150P 159V 179N 240S
95K 105N 150P 159V 179N 227E
95K 105N 150P 156K 179N 198L
95K 105N 150P 156K 179N 180T
95K 105N 150P 156K 159V 240S
95K 150P 159V 180T 227E 240S
95K 150P 159V 180T 198L 240S
95K 150P 159V 180T 198L 227E
95K 150P 159V 179N 227E 240S
95K 105N 179N 198L 227E 240S
95K 105N 179N 180T 227E 240S
95K 105N 179N 180T 198L 240S
95K 105N 179N 180T 198L 227E
95K 105N 159V 198L 227E 240S
95K 105N 159V 180T 227E 240S
95K 105N 159V 180T 198L 240S
95K 105N 159V 180T 198L 227E
95K 105N 159V 179N 227E 240S
95K 105N 159V 179N 198L 240S
95K 105N 159V 179N 198L 227E
95K 105N 159V 179N 180T 240S
95K 105N 159V 179N 180T 227E
95K 105N 159V 179N 180T 198L
95K 105N 156K 198L 227E 240S
95K 105N 156K 180T 227E 240S
95K 105N 156K 180T 198L 240S
95K 105N 156K 180T 198L 227E
95K 105N 156K 179N 227E 240S
95K 105N 156K 179N 198L 240S
95K 105N 156K 179N 198L 227E
95K 105N 156K 179N 180T 240S
95K 105N 156K 179N 180T 227E
95K 105N 156K 179N 180T 198L
95K 105N 156K 159V 227E 240S
95K 105N 156K 159V 198L 240S
95K 105N 156K 159V 198L 227E
95K 105N 156K 159V 180T 240S
95K 105N 156K 159V 180T 227E
95K 105N 156K 159V 180T 198L
95K 105N 156K 159V 179N 240S
95K 105N 156K 159V 179N 227E
95K 105N 156K 159V 179N 198L
95K 105N 156K 159V 179N 180T
95K 105N 156T 198L 227E 240S
95K 105N 156T 180T 227E 240S
95K 105N 156T 180T 198L 240S
95K 105N 156T 179N 227E 240S
95K 105N 156T 179N 198L 240S
95K 105N 156T 179N 198L 227E
95K 105N 156T 179N 180T 240S
95K 105N 156T 179N 180T 227E
95K 105N 156T 179N 180T 198L
95K 105N 156T 159V 227E 240S
95K 105N 156T 159V 198L 240S TABLE 27-continued

| Combinatorial Library Mutants |
|---|

95K 105N 150P 156K 159V 227E
95K 105N 150P 156K 159V 198L
95K 105N 150P 156K 159V 180T
95K 105N 150P 156K 159V 179N
95K 105N 150P 159V 179N 198L
95K 105N 150P 159V 179N 180T
95K 105N 150P 156K 227E 240S
95K 105N 150P 156K 198L 240S
95K 105N 150P 156K 198L 227E
95K 105N 150P 156K 180T 240S
95K 105N 150P 156K 180T 227E
95K 105N 150P 156K 180T 198L
95K 105N 150P 156T 227E 240S
95K 105N 150P 156T 198L 240S
95K 105N 150P 156T 198L 227E
95K 105N 150P 156T 180T 240S
95K 105N 150P 156T 180T 227E
95K 105N 150P 156T 180T 198L
95K 105N 150P 156T 179N 240S
95K 105N 150P 156T 179N 227E
95K 105N 150P 156T 179N 198L
95K 105N 150P 156T 179N 180T
95K 105N 150P 156T 159V 240S
95K 105N 150P 156T 159V 227E
95K 105N 150P 156T 159V 198L
95K 105N 150P 156T 159V 180T
95K 105N 150P 156T 159V 179N
95K 105N 150P 156K 179N 240S
95K 105N 150P 156K 179N 227E
95K 105N 156T 180T 198L 227E
156K 159V 179N 180T 198L 227E 240S
156T 159V 179N 180T 198L 227E 240S
150P 159V 179N 180T 198L 227E 240S
150P 156K 179N 180T 198L 227E 240S
150P 156K 159V 180T 198L 227E 240S
150P 156K 159V 179N 198L 227E 240S
150P 156K 159V 179N 180T 227E 240S
150P 156K 159V 179N 180T 198L 240S
150P 156K 159V 179N 180T 198L 227E
150P 156T 179N 180T 198L 227E 240S
150P 156T 159V 180T 198L 227E 240S
150P 156T 159V 179N 198L 227E 240S
150P 156T 159V 179N 180T 227E 240S
150P 156T 159V 179N 180T 198L 240S
150P 156T 159V 179N 180T 198L 227E
105N 156K 179N 180T 198L 227E 240S
105N 156K 159V 180T 198L 227E 240S
105N 156K 159V 179N 198L 227E 240S
105N 156K 159V 179N 180T 198L 240S
105N 156K 159V 179N 180T 198L 227E
105N 159V 179N 180T 198L 227E 240S
105N 156K 159V 179N 180T 227E 240S
105N 156T 159V 179N 180T 198L 227E
105N 156T 179N 180T 198L 227E 240S
105N 150P 179N 180T 198L 227E 240S
105N 150P 159V 180T 198L 227E 240S
105N 150P 159V 179N 198L 227E 240S
105N 150P 159V 179N 180T 227E 240S
105N 150P 159V 179N 180T 198L 240S
105N 150P 159V 179N 180T 198L 227E
105N 150P 156K 180T 198L 227E 240S
105N 150P 156K 179N 198L 227E 240S
105N 150P 156K 179N 180T 227E 240S
105N 150P 156K 179N 180T 198L 240S
105N 150P 156K 179N 180T 198L 227E
105N 150P 156K 159V 198L 227E 240S
105N 150P 156K 159V 180T 227E 240S
105N 150P 156K 159V 180T 198L 240S
105N 150P 156K 159V 180T 198L 227E
105N 150P 156K 159V 179N 227E 240S
105N 150P 156K 159V 179N 198L 240S
105N 150P 156K 159V 179N 198L 227E
105N 150P 156K 159V 179N 180T 240S
105N 150P 156K 159V 179N 180T 227E
105N 150P 156K 159V 179N 180T 198L
105N 150P 156T 179N 198L 227E 240S
105N 150P 156T 179N 180T 227E 240S
105N 150P 156T 179N 180T 198L 240S

TABLE 27-continued

| Combinatorial Library Mutants |
|---|
| 105N 150P 156T 179N 180T 198L 227E |
| 105N 150P 156T 159V 198L 227E 240S |
| 105N 150P 156T 159V 180T 227E 240S |
| 105N 150P 156T 159V 180T 198L 240S |
| 105N 150P 156T 159V 180T 198L 227E |
| 105N 150P 156T 159V 179N 198L 240S |
| 105N 150P 156T 159V 179N 198L 227E |
| 105N 150P 156T 180T 198L 227E 240S |
| 105N 156T 159V 179N 198L 227E 240S |
| 105N 156T 159V 179N 180T 198L 240S |
| 105N 156T 159V 179N 180T 227E 240S |
| 105N 156T 159V 180T 198L 227E 240S |
| 95K 156T 159V 179N 198L 227E 240S |
| 95K 156T 159V 179N 180T 227E 240S |
| 95K 156T 159V 179N 180T 198L 240S |
| 95K 156T 159V 179N 180T 198L 227E |
| 95K 150P 179N 180T 198L 227E 240S |
| 95K 150P 159V 180T 198L 227E 240S |
| 95K 150P 159V 179N 198L 227E 240S |
| 95K 150P 159V 179N 180T 227E 240S |
| 95K 150P 159V 179N 180T 198L 240S |
| 95K 150P 159V 179N 180T 198L 227E |
| 105N 150P 156T 159V 179N 227E 240S |
| 105N 150P 156T 159V 179N 180T 240S |
| 105N 150P 156T 159V 179N 180T 227E |
| 105N 150P 156T 159V 179N 180T 198L |
| 95K 159V 179N 180T 198L 227E 240S |
| 95K 156K 179N 180T 198L 227E 240S |
| 95K 156K 159V 180T 198L 227E 240S |
| 95K 156K 159V 179N 198L 227E 240S |
| 95K 156K 159V 179N 180T 227E 240S |
| 95K 156K 159V 179N 180T 198L 240S |
| 95K 156K 159V 179N 180T 198L 227E |
| 95K 156T 179N 180T 198L 227E 240S |
| 95K 156T 159V 180T 198L 227E 240S |
| 95K 150P 156K 159V 179N 180T 227E |
| 95K 150P 156K 159V 179N 180T 198L |
| 95K 150P 156T 180T 198L 227E 240S |
| 95K 150P 156T 179N 198L 227E 240S |
| 95K 150P 156T 179N 180T 227E 240S |
| 95K 150P 156T 179N 180T 198L 240S |
| 95K 150P 156T 179N 180T 198L 227E |
| 95K 150P 156T 159V 198L 227E 240S |
| 95K 150P 156T 159V 180T 227E 240S |
| 95K 150P 156T 159V 180T 198L 240S |
| 95K 150P 156T 159V 180T 198L 227E |
| 95K 150P 156T 159V 179N 227E 240S |
| 95K 150P 156T 159V 179N 198L 240S |
| 95K 150P 156T 159V 179N 198L 227E |
| 95K 150P 156T 159V 179N 180T 240S |
| 95K 150P 156T 159V 179N 180T 227E |
| 95K 150P 156K 180T 198L 227E 240S |
| 95K 150P 156K 179N 198L 227E 240S |
| 95K 150P 156K 179N 180T 227E 240S |
| 95K 150P 156K 179N 180T 198L 240S |
| 95K 150P 156K 179N 180T 198L 227E |
| 95K 150P 156K 159V 198L 227E 240S |
| 95K 150P 156K 159V 180T 227E 240S |
| 95K 150P 156K 159V 180T 198L 240S |
| 95K 150P 156K 159V 180T 198L 227E |
| 95K 150P 156K 159V 179N 227E 240S |
| 95K 150P 156K 159V 179N 198L 240S |
| 95K 150P 156K 159V 179N 198L 227E |
| 95K 150P 156K 159V 179N 180T 240S |
| 95K 105N 156K 180T 198L 227E 240S |
| 95K 105N 156K 179N 198L 227E 240S |
| 95K 105N 156K 179N 180T 227E 240S |
| 95K 105N 156K 179N 180T 198L 240S |
| 95K 105N 156K 179N 180T 198L 227E |
| 95K 105N 156K 159V 198L 227E 240S |
| 95K 105N 156K 159V 180T 227E 240S |
| 95K 105N 156K 159V 180T 198L 240S |
| 95K 105N 156K 159V 180T 198L 227E |
| 95K 105N 156K 159V 179N 227E 240S |
| 95K 105N 156K 159V 179N 198L 240S |
| 95K 105N 156K 159V 179N 198L 227E |
| 95K 105N 156K 159V 179N 180T 240S |
| 95K 105N 156K 159V 179N 180T 227E |

TABLE 27-continued

Combinatorial Library Mutants 95K 105N 156K 159V 179N 180T 198L
95K 105N 156T 180T 198L 227E 240S
95K 150P 156T 159V 179N 180T 198L
95K 105N 179N 180T 198L 227E 240S
95K 105N 159V 180T 198L 227E 240S
95K 105N 159V 179N 198L 227E 240S
95K 105N 159V 179N 180T 227E 240S
95K 105N 159V 179N 180T 198L 240S
95K 105N 159V 179N 180T 198L 227E
95K 105N 156T 159V 180T 198L 227E
95K 105N 156T 159V 179N 227E 240S
95K 105N 156T 159V 179N 198L 240S
95K 105N 156T 159V 179N 198L 227E
95K 105N 156T 159V 179N 180T 240S
95K 105N 156T 159V 179N 180T 227E
95K 105N 156T 159V 179N 180T 198L
95K 105N 150P 180T 198L 227E 240S
95K 105N 150P 179N 198L 227E 240S
95K 105N 150P 179N 180T 227E 240S
95K 105N 150P 179N 180T 198L 240S
95K 105N 150P 179N 180T 198L 227E
95K 105N 150P 159V 198L 227E 240S
95K 105N 150P 159V 180T 227E 240S
95K 105N 150P 159V 180T 198L 240S
95K 105N 150P 159V 180T 198L 227E
95K 105N 150P 159V 179N 227E 240S
95K 105N 150P 159V 179N 198L 240S
95K 105N 150P 159V 179N 198L 227E
95K 105N 150P 159V 179N 180T 240S
95K 105N 150P 159V 179N 180T 227E
95K 105N 150P 159V 179N 180T 198L
95K 105N 150P 156K 198L 227E 240S
95K 105N 150P 156T 179N 227E 240S
95K 105N 150P 156T 179N 198L 240S
95K 105N 150P 156T 179N 198L 227E
95K 105N 150P 156T 179N 180T 240S
95K 105N 150P 156T 179N 180T 227E
95K 105N 150P 156T 179N 180T 198L
95K 105N 150P 156T 159V 227E 240S
95K 105N 150P 156T 159V 198L 240S
95K 105N 150P 156T 159V 198L 227E
95K 105N 150P 156T 159V 180T 240S
95K 105N 150P 156T 159V 180T 227E
95K 105N 150P 156T 159V 180T 198L
95K 105N 150P 156T 159V 179N 240S
95K 105N 150P 156T 159V 179N 227E
95K 105N 150P 156T 159V 179N 198L
95K 105N 150P 156T 159V 179N 180T
95K 105N 156T 179N 198L 227E 240S
95K 105N 156T 179N 180T 227E 240S
95K 105N 156T 179N 180T 198L 240S
95K 105N 156T 179N 180T 198L 227E
95K 105N 156T 159V 198L 227E 240S
95K 105N 156T 159V 180T 227E 240S
95K 105N 156T 159V 180T 198L 240S
95K 105N 150P 156K 180T 227E 240S
95K 105N 150P 156K 180T 198L 240S
95K 105N 150P 156K 180T 198L 227E
95K 105N 150P 156K 179N 227E 240S
95K 105N 150P 156K 179N 198L 240S
95K 105N 150P 156K 179N 198L 227E
95K 105N 150P 156K 179N 180T 240S
95K 105N 150P 156K 179N 180T 227E
95K 105N 150P 156K 179N 180T 198L
95K 105N 150P 156K 159V 227E 240S
95K 105N 150P 156K 159V 198L 240S
95K 105N 150P 156K 159V 198L 227E
95K 105N 150P 156K 159V 180T 240S
95K 105N 150P 156K 159V 180T 227E
95K 105N 150P 156K 159V 180T 198L
95K 105N 150P 156K 159V 179N 240S
95K 105N 150P 156K 159V 179N 227E
95K 105N 150P 156K 159V 179N 198L
95K 105N 150P 156K 159V 179N 180T
95K 105N 150P 156T 198L 227E 240S
95K 105N 150P 156T 180T 227E 240S
95K 105N 150P 156T 180T 198L 240S
95K 105N 150P 156T 180T 198L 227E TABLE 27-continued

| Combinatorial Library Mutants |
|---|
| 105N 150P 156K 159V 179N 198L 227E 240S |
| 105N 150P 156K 159V 179N 180T 227E 240S |
| 105N 150P 156K 159V 179N 180T 198L 240S |
| 105N 150P 156K 159V 179N 180T 198L 227E |
| 105N 150P 156T 179N 180T 198L 227E 240S |
| 105N 150P 156T 159V 180T 198L 227E 240S |
| 105N 150P 156T 159V 179N 198L 227E 240S |
| 105N 150P 156T 159V 179N 180T 227E 240S |
| 105N 150P 156T 159V 179N 180T 198L 240S |
| 105N 150P 156T 159V 179N 180T 198L 227E |
| 95K 150P 156T 159V 179N 180T 198L 240S |
| 95K 150P 156T 159V 179N 180T 198L 227E |
| 95K 105N 159V 179N 180T 198L 227E 240S |
| 95K 105N 156K 179N 180T 198L 227E 240S |
| 95K 105N 156K 159V 180T 198L 227E 240S |
| 95K 105N 156K 159V 179N 198L 227E 240S |
| 95K 105N 156K 159V 179N 180T 227E 240S |
| 95K 105N 156K 159V 179N 180T 198L 240S |
| 95K 105N 156K 159V 179N 180T 198L 227E |
| 95K 105N 156T 179N 180T 198L 227E 240S |
| 95K 156K 159V 179N 180T 198L 227E 240S |
| 95K 156T 159V 179N 180T 198L 227E 240S |
| 95K 150P 159V 179N 180T 198L 227E 240S |
| 95K 150P 156K 179N 180T 198L 227E 240S |
| 95K 150P 156K 159V 180T 198L 227E 240S |
| 95K 150P 156K 159V 179N 198L 227E 240S |
| 95K 105N 150P 159V 180T 198L 227E 240S |
| 95K 105N 150P 156T 179N 180T 198L 227E |
| 95K 105N 150P 156T 159V 198L 227E 240S |
| 95K 105N 150P 156T 159V 180T 227E 240S |
| 95K 105N 150P 156T 159V 180T 198L 240S |
| 95K 105N 150P 156T 159V 180T 198L 227E |
| 95K 105N 150P 156T 159V 179N 180T 227E |
| 105N 150P 156K 159V 180T 198L 227E 240S |
| 105N 150P 156K 179N 180T 198L 227E 240S |
| 105N 150P 159V 179N 180T 198L 227E 240S |
| 105N 156K 159V 179N 180T 198L 227E 240S |
| 105N 156T 159V 179N 180T 198L 227E 240S |
| 150P 156K 159V 179N 180T 198L 227E 240S |
| 150P 156T 159V 179N 180T 198L 227E 240S |
| 95K 105N 150P 156T 179N 180T 198L 240S |
| 95K 105N 150P 179N 180T 198L 227E 240S |
| 95K 105N 156T 159V 179N 180T 198L 240S |
| 95K 105N 156T 159V 179N 180T 198L 227E |
| 95K 105N 156T 159V 179N 180T 227E 240S |
| 95K 105N 156T 159V 179N 198L 227E 240S |
| 95K 105N 156T 159V 180T 198L 227E 240S |
| 95K 150P 156K 159V 179N 180T 198L 240S |
| 95K 150P 156K 159V 179N 180T 198L 227E |
| 95K 150P 156K 159V 179N 180T 227E 240S |
| 95K 150P 156T 159V 179N 180T 227E 240S |
| 95K 150P 156T 159V 179N 198L 227E 240S |
| 95K 150P 156T 159V 180T 198L 227E 240S |
| 95K 150P 156T 179N 180T 198L 227E 240S |
| 95K 105N 150P 156T 159V 179N 180T 198L |
| 95K 105N 150P 159V 179N 198L 227E 240S |
| 95K 105N 150P 159V 179N 180T 227E 240S |
| 95K 105N 150P 159V 179N 180T 198L 240S |
| 95K 105N 150P 159V 179N 180T 198L 227E |
| 95K 105N 150P 156K 180T 198L 227E 240S |
| 95K 105N 150P 156K 179N 198L 227E 240S |
| 95K 105N 150P 156K 179N 180T 227E 240S |
| 95K 105N 150P 156K 179N 180T 198L 240S |
| 95K 105N 150P 156K 179N 180T 198L 227E |
| 95K 105N 150P 156K 159V 198L 227E 240S |
| 95K 105N 150P 156K 159V 180T 227E 240S |
| 95K 105N 150P 156K 159V 180T 198L 240S |
| 95K 105N 150P 156K 159V 180T 198L 227E |
| 95K 105N 150P 156K 159V 179N 227E 240S |
| 95K 105N 150P 156K 159V 179N 198L 240S |
| 95K 105N 150P 156K 159V 179N 198L 227E |
| 95K 105N 150P 156K 159V 179N 180T 240S |
| 95K 105N 150P 156K 159V 179N 180T 227E |
| 95K 105N 150P 156K 159V 179N 180T 198L |
| 95K 105N 150P 156T 180T 198L 227E 240S |
| 95K 105N 150P 156T 179N 198L 227E 240S |
| 95K 105N 150P 156T 179N 180T 227E 240S |
| 95K 105N 150P 156T 159V 179N 227E 240S |

TABLE 27-continued

Combinatorial Library Mutants 95K 105N 150P 156T 159V 179N 198L 240S
95K 105N 150P 156T 159V 179N 198L 227E
95K 105N 150P 156T 159V 179N 180T 240S
105N 150P 156K 159V 179N 180T 198L 227E 240S
105N 150P 156T 159V 179N 180T 198L 227E 240S
95K 150P 156K 159V 179N 180T 198L 227E 240S
95K 150P 156T 159V 179N 180T 198L 227E 240S
95K 105N 156K 159V 179N 180T 198L 227E 240S
95K 105N 156T 159V 179N 180T 198L 227E 240S
95K 105N 150P 159V 179N 180T 198L 227E 240S
95K 105N 150P 156K 179N 180T 198L 227E 240S
95K 105N 150P 156K 159V 180T 198L 227E 240S
95K 105N 150P 156K 159V 179N 198L 227E 240S
95K 105N 150P 156K 159V 179N 180T 227E 240S
95K 105N 150P 156K 159V 179N 180T 198L 240S
95K 105N 150P 156K 159V 179N 180T 198L 227E
95K 105N 150P 156T 179N 180T 198L 227E 240S
95K 105N 150P 156T 159V 180T 198L 227E 240S
95K 105N 150P 156T 159V 179N 198L 227E 240S
95K 105N 150P 156T 159V 179N 180T 227E 240S
95K 105N 150P 156T 159V 179N 180T 198L 240S
95K 105N 150P 156T 159V 179N 180T 198L 227E
95K 105N 150P 156K 159V 179N 180T 198L 227E 240S
95K 105N 150P 156T 159V 179N 180T 198L 227E 240S

EXAMPLE 30

Reversibility of Enzymatic Activity Following Decrease in Temperature

In this example, the temperature sensitive hMMP-1 mutants that were confirmed in Example 28B were further assayed to determine whether enzymatic activity at 25° C. was reversible or irreversible following subsequent exposure to elevated temperatures followed by a return to 25° C. The hMMP-1 mutants were expressed in 14 ml culture tubes, as described in Example 28B. The putative Hits were tested for their activities under five conditions: at 25° C., 34° C. or 37° C., and at 34° C. or 37° C. and subsequent re-exposure to the requisite temperature of 25° C. (see Table 16 for reaction conditions). Mutants that were active at 25° C., showed decreased activity when raised to 34° C. or 37° C. (i.e. the ratio of the activities at 25° C./34° C. or 25° C./37° C. is equal to or greater than 1.5), and exhibited a baseline activity when lowered again to 25° C. were scored as "Reversible Hits." Mutants that were active at 25° C., showed decreased activity when raised to 34° C. or 37° C. (i.e. the ratio of the activities at 25° C./34° C. or 25° C./37° C. is equal to or greater than 1.5), and exhibited the same amount of decreased activity when lowered again to 25° C. were scored as "Irreversible Hits."

A. Reaction Conditions

The reversibility of enzymatic activity of each hMMP-1 mutant was determined using the previously described fluorescence assay as modified below. In short, the 4 ul of the supernatant of each hMMP-1 mutant was diluted in TCNB with 1 mM APMA and transferred to a 96-well plate. Five different wells were prepared for each hMMP-1 mutant as set forth in Table 16. The solution was incubated at the initial reaction temperature (25° C., 34° C., or 37° C.) for 2 hours. This activation step cleaves the pro-peptide and generates mature hMMP-1.

Following activation, 100 μl of TCNB with 10 μM Mca-K-P-L-G-L-Dpa-A-R-NH$_2$ (SEQ ID NO.: 535; Mca=(7-Methoxycoumarin-4-yl)acetyl; Dpa=N-3-(2,4,-Dinitrophenyl)-L-2,3-diaminopropionyl) fluorescent substrate was added to each well and reaction conditions were as summarized in Table 28, below. Briefly, each hMMP-1 mutant was exposed to each of the five reaction conditions by incubation of the hMMP-1 mutant in the presence of the fluorogenic substrate for an hour at the initial temperature. For each mutant, baseline activity at 25° C., 34° C., or 37° C. was assessed by incubation with the substrate for an additional 1 hour (2 hour condition) or overnight (overnight condition), followed by fluorescence measurement. To assess the reversibility/irreversibility of activity, samples incubated for an initial 1 hour at 34° C., or 37° C. were lowered to 25° C. and allowed to incubate for either an hour (2 hour condition) or 16 hours (overnight condition), followed by fluorescence measurement. Wild-type hMMP-1 was used as a positive control and supernatant from cells transformed with only vector was used as a negative control. Fluorescence was detected by measuring fluorescence in a fluorescent plate reader at 320 nm exitation/405 nm emission. Relative fluorescence units (RFU) were determined. Duplicate reactions were performed for each sample, reaction temperature, and positive and negative control.

TABLE 28

Reaction Conditions

| Condition | Initial Temperature | Incubation at 25° C. | 2 Hours | Overnight |
|---|---|---|---|---|
| 25° C. | 25° C. | — | 2 hours | overnight |
| 34° C. | 34° C. | — | 2 hours | overnight |
| 34° C. to 25° C. | 34° C. | 25° C. | a) 34° C. for 1 hour<br>b) 25° C. for 1 hour | a) 34° C. for 1 hour<br>b) 25° C. for 16 hours |
| 37° C. | 37° C. | — | 2 hours | overnight |
| 37° C. to 25° C. | 37° C. | 25° C. | a) 37° C. for 1 hour<br>b) 25° C. for 1 hour | a) 37° C. for 1 hour<br>b) 25° C. for 16 hours |

B. Results: Partially Reversible hMMP-1 Mutants

Twenty six hMMP-1 mutants were determined to be partially reversible. Although the activity (in RFU) did not return to baseline activity observed at 25° C., an overall increase in activity was observed when the temperature was returned to 25° C. compared to activity at 34° C. or 37° C. The results are shown in Tables 29-32 below, which list the activities (in RFUs) and the ratios of the activities. Tables 29 and 30 summarize the results of reversibility at 34° C. or 37° C., respectively, of the hMMP-1 partially reversible mutants under the 2 hour condition. Tables 31 and 32 summarize the results of reversibility at 34° C. or 37° C., respectively, of the partially reversible hMMP-1 mutants under the overnight condition. The results are similar under all reaction conditions, temperature and time. The activity at 34° C. or 37° C. overnight is lower than the activity when incubated at 34° C. or 37° C. for one hour then 25° C. overnight. For example, the activity of E180Y at 34° C. is 6080 RFU but its activity at 34° C. then overnight at 25° C. increased to 8570 RFU (see Table 31, below).

TABLE 29

Partially Reversible hMMP-1 mutants (2 Hours, 34° C.)

| hMMP-1 mutation | SEQ ID NO | RFU 25° C. | RFU 34° C. | RFU 34 to 25° C. | Ratio 25° C./ 34° C. | Ratio 25° C./34 to 25° C. |
|---|---|---|---|---|---|---|
| D105A | 340 | 5669.31 | 824.07 | 922.97 | 6.88 | 6.14 |
| D105F | 336 | 2980.00 | 623.89 | 725.03 | 4.78 | 4.11 |
| D105G | 335 | 8821.81 | 2759.24 | 2966.37 | 3.20 | 2.97 |
| D105S | 334 | 9355.63 | 4607.18 | 6681.63 | 2.03 | 1.40 |
| D105T | 333 | 4457.16 | 974.63 | 1534.71 | 4.57 | 2.90 |
| R150P | 345 | 8750.30 | 2315.11 | 2506.15 | 3.78 | 3.49 |
| G159T | 359 | 6704.95 | 2294.40 | 2344.57 | 2.92 | 2.86 |
| E180Y | 374 | 8557.09 | 4979.24 | 6224.87 | 1.72 | 1.37 |
| E180T | 373 | 7870.99 | 1532.35 | 1852.46 | 5.14 | 4.25 |
| E180F | 377 | 8508.13 | 3597.75 | 3915.71 | 2.36 | 2.17 |
| T185H | 389 | 5593.77 | 2278.26 | 2429.05 | 2.46 | 2.30 |
| T185Q | 391 | 7006.87 | 2250.58 | 2397.60 | 3.11 | 2.92 |
| T185A | 395 | 2474.96 | 663.82 | 822.83 | 3.73 | 3.01 |
| T185E | 388 | 3948.43 | 2088.15 | 1862.83 | 1.89 | 2.12 |
| N187R | 398 | 3006.08 | 1352.97 | 1343.94 | 2.22 | 2.24 |
| N187M | 402 | 4934.44 | 1811.35 | 1793.14 | 2.72 | 2.75 |
| N187K | 397 | 4182.49 | 2425.34 | 2415.57 | 1.72 | 1.73 |
| R195V | 411 | 4847.81 | 2724.92 | 2517.49 | 1.78 | 1.93 |
| A198L | 416 | 6756.76 | 2056.50 | 2046.15 | 3.29 | 3.30 |
| A198M | 415 | 3777.50 | 1708.61 | 1725.14 | 2.21 | 2.19 |
| S210V | 419 | 3349.95 | 1249.47 | 1622.57 | 2.68 | 2.06 |
| Y218S | 421 | 2878.50 | 2373.98 | 2187.48 | 1.21 | 1.32 |
| F223E | 422 | 8318.70 | 3685.68 | 5283.08 | 2.26 | 1.57 |
| V227W | 437 | 996.55 | 729.20 | 834.38 | 1.37 | 1.19 |
| L229I | 441 | 2790.27 | 1050.86 | 1738.46 | 2.66 | 1.61 |
| I240C | 448 | 2688.75 | 561.91 | 884.15 | 4.78 | 3.04 |

TABLE 30

Partially Reversible hMMP-1 mutants (2 Hours, 37° C.)

| hMMP-1 mutation | SEQ ID NO | RFU 25° C. | RFU 37° C. | RFU 37 to 25° C. | Ratio 25° C./ 37° C. | Ratio 25° C./37 to 25° C. |
|---|---|---|---|---|---|---|
| D105A | 340 | 5669.31 | 1336.14 | 1509.52 | 4.24 | 3.76 |
| D105F | 336 | 2980.00 | 818.63 | 1004.23 | 3.64 | 2.97 |
| D105G | 335 | 8821.81 | 4313.40 | 4643.53 | 2.05 | 1.90 |
| D105S | 334 | 9355.63 | 7274.97 | 7453.42 | 1.29 | 1.26 |
| D105T | 333 | 4457.16 | 2220.03 | 2177.84 | 2.01 | 2.05 |
| R150P | 345 | 8750.30 | 2497.86 | 3115.73 | 3.50 | 2.81 |
| G159T | 359 | 6704.95 | 2347.74 | 2530.78 | 2.86 | 2.65 |
| E180Y | 374 | 8557.09 | 6079.36 | 6421.56 | 1.41 | 1.33 |
| E180T | 373 | 7870.99 | 1794.15 | 1824.99 | 4.39 | 4.31 |
| E180F | 377 | 8508.13 | 3975.22 | 3981.79 | 2.14 | 2.14 |
| T185H | 389 | 5593.77 | 2534.15 | 2693.25 | 2.21 | 2.08 |
| T185Q | 391 | 7006.87 | 2642.74 | 2589.77 | 2.65 | 2.71 |
| T185A | 395 | 2474.96 | 707.09 | 730.58 | 3.50 | 3.39 |
| T185E | 388 | 3948.43 | 2091.32 | 2106.55 | 1.89 | 1.87 |
| N187R | 398 | 3006.08 | 1421.87 | 1476.42 | 2.11 | 2.04 |

TABLE 30-continued

Partially Reversible hMMP-1 mutants (2 Hours, 37° C.)

| hMMP-1 mutation | SEQ ID NO | RFU 25° C. | RFU 37° C. | RFU 37 to 25° C. | Ratio 25° C./ 37° C. | Ratio 25° C./37 to 25° C. |
|---|---|---|---|---|---|---|
| N187M | 402 | 4934.44 | 1893.07 | 1998.97 | 2.61 | 2.47 |
| N187K | 397 | 4182.49 | 2652.79 | 2902.79 | 1.58 | 1.44 |
| R195V | 411 | 4847.81 | 2984.10 | 3555.03 | 1.62 | 1.36 |
| A198L | 416 | 6756.76 | 2642.76 | 2540.07 | 2.56 | 2.66 |
| A198M | 415 | 3777.50 | 2155.58 | 2802.78 | 1.75 | 1.35 |
| S210V | 419 | 3349.95 | 2314.86 | 2277.32 | 1.45 | 1.47 |
| Y218S | 421 | 2878.50 | 2350.27 | 2383.67 | 1.22 | 1.21 |
| F223E | 422 | 8318.70 | 6209.93 | 7415.02 | 1.34 | 1.12 |
| V227W | 437 | 996.55 | 787.87 | 850.67 | 1.26 | 1.17 |
| L229I | 441 | 2790.27 | 1803.44 | 2453.07 | 1.55 | 1.14 |
| I240C | 448 | 2688.75 | 853.66 | 872.62 | 3.15 | 3.08 |

TABLE 31

Partially Reversible hMMP-1 mutants (Overnight, 34° C.)

| hMMP-1 mutation | SEQ ID NO | RFU 25° C. | RFU 34° C. | RFU 34 to 25° C. | Ratio 25° C./ 34° C. | Ratio 25° C./34 to 25° C. |
|---|---|---|---|---|---|---|
| D105A | 340 | 8466.62 | 1302.84 | 1532.38 | 6.50 | 5.53 |
| D105F | 336 | 6725.59 | 938.60 | 1172.86 | 7.17 | 5.73 |
| D105G | 335 | 8940.06 | 3560.75 | 5314.44 | 2.51 | 1.68 |
| D105S | 334 | 9300.85 | 5584.70 | 9413.56 | 1.67 | 0.99 |
| D105T | 333 | 7910.47 | 1899.25 | 3254.16 | 4.17 | 2.43 |
| R150P | 345 | 9011.11 | 3533.16 | 4443.96 | 2.55 | 2.03 |
| G159T | 359 | 9105.95 | 3210.57 | 4179.05 | 2.84 | 2.18 |
| E180Y | 374 | 9281.77 | 6080.89 | 8570.48 | 1.53 | 1.08 |
| E180T | 373 | 8475.04 | 2585.89 | 3901.87 | 3.28 | 2.17 |
| E180F | 377 | 9360.74 | 5183.25 | 7022.64 | 1.81 | 1.33 |
| T185H | 389 | 8531.85 | 3164.69 | 5520.76 | 2.70 | 1.55 |
| T185Q | 391 | 9044.23 | 3639.00 | 5467.27 | 2.49 | 1.65 |
| T185A | 395 | 6156.97 | 1110.68 | 1585.53 | 5.54 | 3.88 |
| T185E | 388 | 8479.18 | 3868.06 | 4836.97 | 2.19 | 1.75 |
| N187R | 398 | 7593.11 | 2415.63 | 3156.74 | 3.14 | 2.41 |
| N187M | 402 | 8605.76 | 2769.52 | 4008.68 | 3.11 | 2.15 |
| N187K | 397 | 8667.36 | 3458.94 | 5465.35 | 2.51 | 1.59 |
| R195V | 411 | 8634.05 | 4648.03 | 5966.81 | 1.86 | 1.45 |
| A198L | 416 | 8795.36 | 3469.36 | 5027.30 | 2.54 | 1.75 |
| A198M | 415 | 8352.73 | 3215.69 | 4220.51 | 2.60 | 1.98 |
| S210V | 419 | 7104.17 | 2441.96 | 3664.23 | 2.91 | 1.94 |
| Y218S | 421 | 7740.61 | 4057.37 | 5769.79 | 1.91 | 1.34 |
| F223E | 422 | 9650.44 | 4849.58 | 9311.40 | 1.99 | 1.04 |
| V227W | 437 | 3070.92 | 1370.13 | 1632.51 | 2.24 | 1.88 |
| L229I | 441 | 7333.92 | 1832.18 | 4427.24 | 4.00 | 1.66 |
| I240C | 448 | 6170.51 | 1174.96 | 2389.06 | 5.25 | 2.58 |

TABLE 32

Partially Reversible hMMP-1 mutants (Overnight, 37° C.)

| hMMP-1 mutation | SEQ ID NO | RFU 25° C. | RFU 37° C. | RFU 37 to 25° C. | Ratio 25° C./ 37° C. | Ratio 25° C./37 to 25° C. |
|---|---|---|---|---|---|---|
| D105A | 340 | 8466.62 | 1931.17 | 2589.08 | 4.38 | 3.27 |
| D105F | 336 | 6725.59 | 1173.23 | 1759.31 | 5.73 | 3.82 |
| D105G | 335 | 8940.06 | 5390.32 | 7139.57 | 1.66 | 1.25 |
| D105S | 334 | 9300.85 | 8234.95 | 8615.33 | 1.13 | 1.08 |
| D105T | 333 | 7910.47 | 3292.01 | 4482.74 | 2.40 | 1.76 |
| R150P | 345 | 9011.11 | 3559.66 | 5181.30 | 2.53 | 1.74 |
| G159T | 359 | 9105.95 | 3160.07 | 4338.35 | 2.88 | 2.10 |
| E180Y | 374 | 9281.77 | 6894.61 | 8986.47 | 1.35 | 1.03 |
| E180T | 373 | 8475.04 | 2809.15 | 3649.72 | 3.02 | 2.32 |
| E180F | 377 | 9360.74 | 5335.15 | 7183.36 | 1.75 | 1.30 |
| T185H | 389 | 8531.85 | 3515.59 | 6101.91 | 2.43 | 1.40 |

TABLE 32-continued

Partially Reversible hMMP-1 mutants (Overnight, 37° C.)

| hMMP-1 mutation | SEQ ID NO | RFU 25° C. | RFU 37° C. | RFU 37 to 25° C. | Ratio 25° C./ 37° C. | Ratio 25° C./37 to 25° C. |
|---|---|---|---|---|---|---|
| T185Q | 391 | 9044.23 | 4012.93 | 5623.60 | 2.25 | 1.61 |
| T185A | 395 | 6156.97 | 1059.61 | 1315.46 | 5.81 | 4.68 |
| T185E | 388 | 8479.18 | 3892.33 | 5330.81 | 2.18 | 1.59 |
| N187R | 398 | 7593.11 | 2370.01 | 3425.18 | 3.20 | 2.22 |
| N187M | 402 | 8605.76 | 2720.28 | 4400.27 | 3.16 | 1.96 |
| N187K | 397 | 8667.36 | 3709.62 | 6374.32 | 2.34 | 1.36 |
| R195V | 411 | 8634.05 | 4960.91 | 7212.05 | 1.74 | 1.20 |
| A198L | 416 | 8795.36 | 4181.78 | 5395.22 | 2.10 | 1.63 |
| A198M | 415 | 8352.73 | 3637.79 | 5914.49 | 2.30 | 1.41 |
| S210V | 419 | 7104.17 | 3939.90 | 4626.58 | 1.80 | 1.54 |
| Y218S | 421 | 7740.61 | 4093.29 | 6181.92 | 1.89 | 1.25 |
| F223E | 422 | 9650.44 | 7645.34 | 9149.09 | 1.26 | 1.05 |
| V227W | 437 | 3070.92 | 1456.45 | 1695.81 | 2.11 | 1.81 |
| L229I | 441 | 7333.92 | 3268.93 | 5729.00 | 2.24 | 1.28 |
| I240C | 448 | 6170.51 | 2223.23 | 2050.31 | 2.78 | 3.01 |

C. Results: Non Reversible hMMP-1 Mutants

Thirty eight hMMP-1 mutants were determined to be non reversible. The activity of these mutants at 34° C. or 37° C., which is decreased compared to the activity at 25° C., remained decreased when lowered to 25° C. The results are shown in Tables 33-36 below, which list the activities (in RFUs) and the ratios of the activities. Tables 33 and 34 summarize the results or at 34° C. or 37° C., respectively, of the hMMP-1 irreversible mutants under the two hour condition. Tables 35 and 36 summarize the results of reversibility at 34° C. or 37° C., respectively, of the irreversible hMMP-1 mutants under the overnight condition. The results are similar under all reaction conditions, temperature and time. The activity at 34° C. or 37° C. overnight is the same or similar to the activity when incubated at 34° C. or 37° C. for one hour then 25° C. overnight. For example, the activity of D105R at 34° C. is 1407 RFU and its activity at 34° C. then overnight at 25° C. is 1424 RFU (see Table 35, below).

TABLE 33

Non Reversible hMMP-1 mutants (2 Hours, 34° C.)

| hMMP-1 mutation | SEQ ID NO | RFU 25° C. | RFU 34° C. | RFU 34 to 25° C. | Ratio 25° C./ 34° C. | Ratio 25° C./34 to 25° C. |
|---|---|---|---|---|---|---|
| L95K | 328 | 4650.42 | 748.29 | 833.29 | 6.21 | 5.58 |
| D105I | 338 | 6832.34 | 780.32 | 908.39 | 8.76 | 7.52 |
| D105L | 339 | 4206.38 | 534.24 | 630.66 | 7.87 | 6.67 |
| D105N | 332 | 8920.05 | 918.13 | 1128.03 | 9.72 | 7.91 |
| D105R | 331 | 2821.20 | 722.46 | 843.19 | 3.90 | 3.35 |
| D105W | 337 | 6663.80 | 1690.93 | 2266.26 | 3.94 | 2.94 |
| D151G | 346 | 1264.62 | 589.27 | 664.86 | 2.15 | 1.90 |
| F155A | 348 | 2824.01 | 779.72 | 735.02 | 3.62 | 3.84 |
| D156K | 350 | 8576.47 | 2210.63 | 2318.28 | 3.88 | 3.70 |
| D156T | 352 | 8727.27 | 2679.17 | 2770.95 | 3.26 | 3.15 |
| D156L | 356 | 2916.24 | 576.84 | 655.46 | 5.06 | 4.45 |
| D156A | 357 | 2299.63 | 533.68 | 635.67 | 4.31 | 3.62 |
| D156W | 354 | 1502.86 | 539.74 | 637.12 | 2.78 | 2.36 |
| D156V | 355 | 1593.06 | 534.71 | 634.83 | 2.98 | 2.51 |
| D156H | 349 | 5387.79 | 698.77 | 784.55 | 7.71 | 6.87 |
| D156R | 351 | 7020.81 | 793.83 | 881.39 | 8.84 | 7.97 |
| G159V | 363 | 4673.44 | 856.78 | 789.92 | 5.45 | 5.92 |
| A176F | 365 | 1609.85 | 654.43 | 633.13 | 2.46 | 2.54 |
| D179N | 368 | 5660.69 | 644.51 | 644.98 | 8.78 | 8.78 |
| D181L | 382 | 2710.97 | 619.39 | 645.65 | 4.38 | 4.20 |
| D181K | 378 | 1130.63 | 625.01 | 609.58 | 1.81 | 1.85 |
| E182T | 384 | 3702.08 | 791.23 | 805.48 | 4.68 | 4.60 |
| E182Q | 383 | 1331.50 | 639.84 | 623.88 | 2.08 | 2.13 |

TABLE 33-continued

Non Reversible hMMP-1 mutants (2 Hours, 34° C.)

| hMMP-1 mutation | SEQ ID NO | RFU 25° C. | RFU 34° C. | RFU 34 to 25° C. | Ratio 25° C./ 34° C. | Ratio 25° C./34 to 25° C. |
|---|---|---|---|---|---|---|
| T185R | 390 | 2637.31 | 1187.63 | 1158.47 | 2.22 | 2.28 |
| N187F | 401 | 3227.96 | 877.21 | 823.16 | 3.68 | 3.92 |
| N187I | 404 | 4218.55 | 849.11 | 869.19 | 4.97 | 4.85 |
| G206A | 418 | 872.27 | 603.01 | 592.13 | 1.45 | 1.47 |
| G206S | 417 | 932.69 | 492.65 | 507.75 | 1.89 | 1.84 |
| V227C | 433 | 1998.67 | 950.01 | 1115.17 | 2.10 | 1.79 |
| V227E | 430 | 7904.54 | 839.00 | 906.06 | 9.42 | 8.72 |
| Q228P | 439 | 1082.56 | 607.78 | 617.33 | 1.78 | 1.75 |
| L229T | 440 | 1221.05 | 580.15 | 605.83 | 2.10 | 2.02 |
| D233E | 443 | 2195.02 | 1393.95 | 1332.07 | 1.57 | 1.65 |
| I234A | 447 | 2375.42 | 1473.70 | 1456.58 | 1.61 | 1.63 |
| I234T | 446 | 1199.18 | 713.83 | 775.40 | 1.68 | 1.55 |
| I234E | 444 | 3920.02 | 705.86 | 829.15 | 5.55 | 4.73 |
| I240S | 449 | 3867.71 | 973.97 | 1027.84 | 3.97 | 3.76 |

TABLE 34

Non Reversible hMMP-1 mutants (2 Hours, 37° C.)

| hMMP-1 mutation | SEQ ID NO | RFU 25° C. | RFU 37° C. | RFU 37 to 25° C. | Ratio 25° C./ 37° C. | Ratio 25° C./37 to 25° C. |
|---|---|---|---|---|---|---|
| L95K | 328 | 4650.42 | 746.89 | 1092.61 | 6.23 | 4.26 |
| D105I | 338 | 6832.34 | 1110.07 | 1104.96 | 6.15 | 6.18 |
| D105L | 339 | 4206.38 | 607.46 | 624.88 | 6.92 | 6.73 |
| D105N | 332 | 8920.05 | 1727.44 | 1820.97 | 5.16 | 4.90 |
| D105R | 331 | 2821.20 | 813.68 | 846.09 | 3.47 | 3.33 |
| D105W | 337 | 6663.80 | 3081.59 | 3123.49 | 2.16 | 2.13 |
| D151G | 346 | 1264.62 | 616.51 | 628.65 | 2.05 | 2.01 |
| F155A | 348 | 2824.01 | 746.59 | 867.76 | 3.78 | 3.25 |
| D156K | 350 | 8576.47 | 2310.30 | 2080.22 | 3.71 | 4.12 |
| D156T | 352 | 8727.27 | 2752.35 | 2251.21 | 3.17 | 3.88 |
| D156L | 356 | 2916.24 | 688.08 | 652.06 | 4.24 | 4.47 |
| D156A | 357 | 2299.63 | 554.21 | 606.45 | 4.15 | 3.79 |
| D156W | 354 | 1502.86 | 575.12 | 582.43 | 2.61 | 2.58 |
| D156V | 355 | 1593.06 | 542.36 | 544.49 | 2.94 | 2.93 |
| D156H | 349 | 5387.79 | 819.82 | 881.23 | 6.57 | 6.11 |
| D156R | 351 | 7020.81 | 872.40 | 944.17 | 8.05 | 7.44 |
| G159V | 363 | 4673.44 | 838.46 | 932.14 | 5.57 | 5.01 |
| A176F | 365 | 1609.85 | 618.72 | 741.21 | 2.60 | 2.17 |
| D179N | 368 | 5660.69 | 656.31 | 636.18 | 8.63 | 8.90 |
| D181L | 382 | 2710.97 | 611.92 | 668.31 | 4.43 | 4.06 |
| D181K | 378 | 1130.63 | 608.68 | 646.77 | 1.86 | 1.75 |
| E182T | 384 | 3702.08 | 826.28 | 746.25 | 4.48 | 4.96 |
| E182Q | 383 | 1331.50 | 623.11 | 629.01 | 2.14 | 2.12 |
| T185R | 390 | 2637.31 | 1183.37 | 1158.87 | 2.23 | 2.28 |
| N187F | 401 | 3227.96 | 931.04 | 856.03 | 3.47 | 3.77 |
| N187I | 404 | 4218.55 | 887.80 | 879.78 | 4.75 | 4.80 |
| G206A | 418 | 872.27 | 586.57 | 654.37 | 1.49 | 1.33 |
| G206S | 417 | 932.69 | 463.60 | 552.97 | 2.01 | 1.69 |
| V227C | 433 | 1998.67 | 992.19 | 1130.51 | 2.01 | 1.77 |
| V227E | 430 | 7904.54 | 1015.12 | 1127.74 | 7.79 | 7.01 |
| Q228P | 439 | 1082.56 | 586.63 | 777.28 | 1.85 | 1.39 |
| L229T | 440 | 1221.05 | 564.49 | 747.87 | 2.16 | 1.63 |
| D233E | 443 | 2195.02 | 1454.71 | 1976.42 | 1.51 | 1.11 |
| I234A | 447 | 2375.42 | 1594.08 | 1460.23 | 1.49 | 1.63 |
| I234T | 446 | 1199.18 | 796.81 | 833.55 | 1.50 | 1.44 |
| I234E | 444 | 3920.02 | 923.57 | 867.78 | 4.24 | 4.52 |
| I240S | 449 | 3867.71 | 1575.05 | 1594.10 | 2.46 | 2.43 |

TABLE 35

Non Reversible hMMP-1 mutants (Overnight, 34° C.)

| hMMP-1 mutation | SEQ ID NO | RFU 25° C. | RFU 34° C. | RFU 34 to 25° C. | Ratio 25° C./ 34° C. | Ratio 25° C./34 to 25° C. |
|---|---|---|---|---|---|---|
| L95K | 328 | 7744.34 | 1803.12 | 1892.59 | 4.29 | 4.09 |
| D105I | 338 | 8394.32 | 1614.57 | 1736.52 | 5.20 | 4.83 |
| D105L | 339 | 6546.78 | 957.95 | 988.23 | 6.83 | 6.62 |
| D105N | 332 | 9119.04 | 1459.16 | 1822.40 | 6.25 | 5.00 |
| D105R | 331 | 5775.25 | 1407.06 | 1424.59 | 4.10 | 4.05 |
| D105W | 337 | 8617.36 | 2851.22 | 4709.94 | 3.02 | 1.83 |
| D151G | 346 | 1956.65 | 959.80 | 1013.03 | 2.04 | 1.93 |
| F155A | 348 | 4891.89 | 2016.76 | 1493.70 | 2.43 | 3.28 |
| D156K | 350 | 8696.27 | 3968.92 | 4371.25 | 2.19 | 1.99 |
| D156T | 352 | 8972.20 | 3971.43 | 4480.62 | 2.26 | 2.00 |
| D156L | 356 | 5254.55 | 972.64 | 1011.27 | 5.40 | 5.20 |
| D156A | 357 | 3585.37 | 1098.25 | 1057.84 | 3.26 | 3.39 |
| D156W | 354 | 2570.24 | 1091.27 | 1126.01 | 2.36 | 2.28 |
| D156V | 355 | 2208.99 | 954.21 | 954.54 | 2.31 | 2.31 |
| D156H | 349 | 7587.19 | 1451.49 | 1440.25 | 5.23 | 5.27 |
| D156R | 351 | 8622.23 | 1735.02 | 1760.60 | 4.97 | 4.90 |
| G159V | 363 | 6555.27 | 1821.53 | 1524.05 | 3.60 | 4.30 |
| A176F | 365 | 4191.69 | 1414.21 | 1181.99 | 2.96 | 3.55 |
| D179N | 368 | 7317.57 | 1504.84 | 1458.70 | 4.86 | 5.02 |
| D181L | 382 | 4534.34 | 1078.98 | 984.43 | 4.20 | 4.61 |
| D181K | 378 | 1869.47 | 946.27 | 841.77 | 1.98 | 2.22 |
| E182T | 384 | 6752.25 | 1483.52 | 1570.77 | 4.55 | 4.30 |
| E182Q | 383 | 2212.75 | 1065.07 | 929.49 | 2.08 | 2.38 |
| T185R | 390 | 6281.97 | 2425.71 | 2808.30 | 2.59 | 2.24 |
| N187F | 401 | 7352.85 | 1612.23 | 1533.32 | 4.56 | 4.80 |
| N187I | 404 | 8306.40 | 1459.25 | 1598.90 | 5.69 | 5.20 |
| G206A | 418 | 2492.53 | 1038.14 | 906.63 | 2.40 | 2.75 |
| G206S | 417 | 2845.84 | 908.82 | 816.00 | 3.13 | 3.49 |
| V227C | 433 | 5833.84 | 2207.20 | 2739.65 | 2.64 | 2.13 |
| V227E | 430 | 8630.90 | 2283.07 | 2096.30 | 3.78 | 4.12 |
| Q228P | 439 | 3673.33 | 1162.95 | 1213.48 | 3.16 | 3.03 |
| L229T | 440 | 3543.75 | 1103.34 | 1105.90 | 3.21 | 3.20 |
| D233E | 443 | 6694.93 | 2570.71 | 3171.20 | 2.60 | 2.11 |
| I234A | 447 | 6250.56 | 3890.90 | 3608.10 | 1.61 | 1.73 |
| I234T | 446 | 3507.08 | 1099.58 | 1194.99 | 3.19 | 2.93 |
| I234E | 444 | 7541.73 | 1365.08 | 1817.16 | 5.52 | 4.15 |
| I240S | 449 | 4376.99 | 2108.15 | 2290.56 | 2.08 | 1.91 |

TABLE 36

Non Reversible hMMP-1 mutants (Overnight, 37° C.)

| hMMP-1 mutation | SEQ ID NO | RFU 25° C. | RFU 37° C. | RFU 37 to 25° C. | Ratio 25° C./ 37° C. | Ratio 25° C./37 to 25° C. |
|---|---|---|---|---|---|---|
| L95K | 328 | 7744.34 | 1677.96 | 2463.18 | 4.62 | 3.14 |
| D105I | 338 | 8394.32 | 1958.96 | 1925.73 | 4.29 | 4.36 |
| D105L | 339 | 6546.78 | 1070.51 | 939.53 | 6.12 | 6.97 |
| D105N | 332 | 9119.04 | 2347.74 | 2813.87 | 3.88 | 3.24 |
| D105R | 331 | 5775.25 | 1499.57 | 1312.01 | 3.85 | 4.40 |
| D105W | 337 | 8617.36 | 4593.06 | 5698.08 | 1.88 | 1.51 |
| D151G | 346 | 1956.65 | 1097.68 | 900.59 | 1.78 | 2.17 |
| F155A | 348 | 4891.89 | 1843.31 | 1882.95 | 2.65 | 2.60 |
| D156K | 350 | 8696.27 | 3858.90 | 4126.13 | 2.25 | 2.11 |
| D156T | 352 | 8972.20 | 3854.84 | 3990.29 | 2.33 | 2.25 |
| D156L | 356 | 5254.55 | 1232.94 | 1008.08 | 4.26 | 5.21 |
| D156A | 357 | 3585.37 | 1110.73 | 940.62 | 3.23 | 3.81 |
| D156W | 354 | 2570.24 | 1206.22 | 997.15 | 2.13 | 2.58 |
| D156V | 355 | 2208.99 | 997.64 | 777.35 | 2.21 | 2.84 |
| D156H | 349 | 7587.19 | 1763.27 | 1536.01 | 4.30 | 4.94 |
| D156R | 351 | 8622.23 | 1846.71 | 1764.13 | 4.67 | 4.89 |
| G159V | 363 | 6555.27 | 1683.20 | 1842.91 | 3.89 | 3.56 |
| A176F | 365 | 4191.69 | 1336.32 | 1553.01 | 3.14 | 2.70 |
| D179N | 368 | 7317.57 | 1485.28 | 1378.59 | 4.93 | 5.31 |
| D181L | 382 | 4534.34 | 1000.80 | 1020.08 | 4.53 | 4.45 |
| D181K | 378 | 1869.47 | 928.55 | 895.45 | 2.01 | 2.09 |
| E182T | 384 | 6752.25 | 1496.55 | 1319.53 | 4.51 | 5.12 |
| E182Q | 383 | 2212.75 | 1035.24 | 916.32 | 2.14 | 2.41 |
| T185R | 390 | 6281.97 | 2300.61 | 2829.34 | 2.73 | 2.22 |
| N187F | 401 | 7352.85 | 1704.23 | 1533.08 | 4.31 | 4.80 |
| N187I | 404 | 8306.40 | 1465.77 | 1560.83 | 5.67 | 5.32 |
| G206A | 418 | 2492.53 | 974.96 | 1057.32 | 2.56 | 2.36 |
| G206S | 417 | 2845.84 | 808.42 | 908.44 | 3.52 | 3.13 |
| V227C | 433 | 5833.84 | 2432.82 | 2707.71 | 2.40 | 2.15 |
| V227E | 430 | 8630.90 | 2152.81 | 2615.26 | 4.01 | 3.30 |
| Q228P | 439 | 3673.33 | 1081.32 | 1681.57 | 3.40 | 2.18 |
| L229T | 440 | 3543.75 | 1030.05 | 1488.58 | 3.44 | 2.38 |
| D233E | 443 | 6694.93 | 2661.43 | 4531.45 | 2.52 | 1.48 |
| I234A | 447 | 6250.56 | 4043.80 | 3433.03 | 1.55 | 1.82 |
| I234T | 446 | 3507.08 | 1228.23 | 1397.18 | 2.86 | 2.51 |
| I234E | 444 | 7541.73 | 1901.96 | 1783.16 | 3.97 | 4.23 |
| I240S | 449 | 4376.99 | 2592.19 | 3417.53 | 1.69 | 1.28 |

EXAMPLE 31

Proteolytic Activity of hMMP-1 on Insoluble Collagen

In this example, the collagenase activity of hMMP-1 was assessed for the protein substrate collagen using SDS-PAGE analysis. Wildtype hMMP-1 cleaves insoluble collagen (α1 (I) and α2(I) chains) into three-quarter and one-quarter length digestion products. In this assay, a fluorescein isothiocyanate (FITC)-conjugated collagen was used as the substrate and the reaction was monitored by SDS-PAGE of the reaction products. Cleavage of α1(I) and α2(I) collagen chains results in three-quarter and one-quarter length digestion products which are distinguishable from full length collagen by separation on SDS polyacrylamide gels. Alternatively, cleavage was assessed by fluorometric analysis. A similar assay can be used to assess the activity of mutant hMMPs for cleavage activity at 25° C. versus 34° C. or 37° C.

A. SDS-PAGE Analysis

In short, 2 μg of hMMP-1 (purchased from R&D Systems, #901-MP; or BAP006_2 and BAP006_10 purified as described in Example 27) was diluted in TCNB containing 1 mM AMPA and incubated at the reaction temperature (25° C. or 37° C.) for 2 hours. This activation step cleaves the pro-peptide and generates mature hMMP-1. Subsequently, 6 μg of insoluble collagen conjugated to fluorescein isothiocyanate (FITC) (Anaspec #85111 or Sigma Collagen #C4361) in 20 μl TCNB was added to each activated hMMP-1 aliquot and the mixture was incubated at 25° C. or 37° C. for 24 hours or 6 days.

Cleavage of the insoluble collagen was observed by SDS/PAGE. The reaction mixture was separated on a 7.5% SDS polyacrylamide gel and visualized by staining with Coomassie Blue dye. SDS/PAGE results show that after 24 hours incubation at 25° C. or 37° C., hMMP-1 partially cleaved the α1(I) and α2(I) collagen chains into ¾ and ¼ length digestion products for all hMMP-1 proteins tested. After 6 days at 25° C., complete cleavage into ¾ and ¼ length digestion products was observed. After 6 days at 37° C., the collagen was digested completely. The ¾ and ¼ length collagen digestion products are thermally unstable at body temperature.

B. Fluorometric Analysis

Alternatively, collagenase activity was measured using a fluorescence assay. 5 μg hMMP-1 (purchased from R&D Systems, #901-MP; or BAP006_2 and BAP006_10 purified as described in Example 27) was diluted in TCNB containing 1 mM AMPA to a final concentration and incubated at 37° C. for 2 hours. The activity of hMMP-1 for FITC-labeled collagen (Sigma #C4361 or Elastin #CF308) was assessed using a protocol adapted from Baici A et al. (1980) Anal. Biochem., 108: 230-232). Briefly, hMMP-1 was incubated with the substrate for 144 hours at 37° C. As a negative control, the substrate was incubated with buffer only. Following incubation, the reaction mixture was first centrifuged to remove insoluble particles. Fluorescence of the supernatant was detected by measuring fluorescence in a fluorescent plate reader at 495 nm excitation/520 nm emission. Relative fluorescence units (RFU) were determined. Duplicate reactions were performed for each sample.

The results (see Tables 37 and 38 below) show that incubation of insoluble collagen with wildtype hMMP-1 at 37° C. for 144 hours resulted in cleavage of collagen as indicated by high RFU values compared to buffer only control. For example, for cleavage of collagen from Sigma, all hMMPs tested had an RFU between about 1000.00-1200.00 compared to buffer only with an RFU value of about 400.00. The activity of purified collagens from CHO-S (BAP006_2) and BL21 cells (BAP006_10) for cleavage of Sigma insoluble collagen was comparable to hMMP-1 purchased from R&D systems. For cleavage of Elastin collagen, the activity of recombinant hMMP-1 purchased from R&D and BAP006_10 were about 3000.00 RFU, while the activity of BAP006_2 was about 2000.00 RFU. Buffer only exhibited a background fluorescence for cleavage of Elastin collagen of about 1500.00 RFU.

TABLE 37

Cleavage of Collagen (Sigma Insoluble Substrate)

| hMMP-1 | 37° C. | 37° C. | Avg 37° C. | St Dev |
|---|---|---|---|---|
| R&D systems | 1163.17 | 1137.81 | 1150.49 | 17.93 |
| Buffer only | 481.49 | 490.57 | 486.03 | 6.42 |
| BAP006_2 (CHO) | 1265.61 | 1275.17 | 1270.39 | 6.76 |
| BAP006_10 (BL21) | 1292.36 | 1335.14 | 1313.75 | 30.25 |

TABLE 38

Cleavage of Collagen (Elastin Insoluble Substrate)

| hMMP-1 | 37° C. | 37° C. | Avg 37° C. | St Dev |
|---|---|---|---|---|
| R&D systems | 3488.224 | 2981.417 | 3235.32 | 357.66 |
| Buffer only | 1312.511 | 1807.479 | 1560.00 | 350.00 |
| BAP006_2 (CHO) | 1729.757 | 2297.573 | 2013.67 | 401.51 |
| BAP006_10 (BL21) | 2669.758 | 3056.381 | 2863.07 | 273.38 |

Since modifications will be apparent to those of skill in this art, it is intended that this invention be limited only by the scope of the appended claims.

SEQUENCE LISTING (538 sequences)

SEQ ID NO: 1 - protein, 220 aa, Homo sapiens
  Cathepsin L mature
  cathepsin L1 heavy chain 1-175
  cathepsin L1 light chain 179-220
APRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 2 - protein, 22 aa, Homo sapiens
  kappa IgG heterologous signal sequence
MDMRVPAQLLGLLLLWLPGARG

SEQ ID NO: 3 - DNA, 1032 bp, Homo sapiens
  Optimized synthetic Cat-L construct with heterologous signal sequence and Nhe1 and BamHI restriction sites
gctagcatggacatgcgcgtacctgctcagttgttggggctcttgctgctgtggttgcccggggcacgtgggactctgaccttcgaccattcactggaggcccagtggactaagtggaaggctatgcataatcgactttacggcatgaacgaggagggttggcggcgggctgtgtgggagaagaatatgaaaatgatcgaactgcataaccaggaatacagagagggcaagcacagttttaccatggcaatgaatgcatttggggacatgactagcgaggaatttcggcaagtgatgaatggtttccagaatcgcaagccaagaaaagggaaggtcttccaggagcccctcttctacgaggcccctcgtagtgtcgactggcgggagaaaggctacgtgacaccagtcaaaaaccagggccaatgcggctcctgctgggcattttctgccaccggtgctctggaaggacaaatgttcaggaagactggccgtctcatctccttgtccgaacagaacctggtggactgctccgggccacaggggaatgaggggtgcaacggggggcttatggactacgccttccagtacgtgcaggataatgggggtctcgattccgaggaatcctacccctacgaagcaactgaggaatcttgcaagtataaccctaagtattccgtggcaaatgatactggcttcgtggatatccctaaacaggaaaaggccctcatgaaggccgtagccaccgtgggccccatctctgtcgcaattgacgctggtcacgagtctttcctcttctataaggaaggtatatactttgaacccgattgcagcagtgaggacatggatcatggcgtactcgtcgtcgggtatggttttgagagtaccgaatcagataataataaatattggctggtgaaaaacagctggggtgaggagtggggtatgggtggctacgtcaagatggccaaggaccgtaggaaccattgtggtatcgcatctgctgcatcttatcccactgtgtaatagggatcc

SEQ ID NO: 4 - protein, 338 aa, Homo sapiens
  Optimized synthetic Cat-L construct with heterologous signal sequence
MDMRVPAQLLGLLLLWLPGARGTLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 5 - DNA, 6201 bp, Artificial Sequence
  synthetic Cat-L HZ24 expression vector with heterologous signal sequence
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatggacatgcgcgtacctgctcagttgttggggctcttgctgctgtggttgcccggggcacgtgggactctgaccttcgaccattcactggaggcccagtggactaagtggaaggctatgcataatcgactttacggcatgaacgaggagggttggcggcgggctgtgtgggagaagaatatgaaaatgatcgaactgcataaccaggaatacagagagggcaagcacagttttaccatggcaatgaatgcatttggggacatgactagcgaggaatttcggcaagtgatgaatggtttccagaatcgcaagccaagaaaagggaaggtcttccaggagcccctcttctacgaggcccctcgtagtgtcgactggcgggagaaaggctacgtgacaccagtcaaaaaccagggccaatgcggctcctgctgggcattttctgccaccggtgctctggaaggacaaatgttcaggaagactggccgtctcatctccttgtccgaacagaacctggtggactgctccgggccacaggggaatgaggggtgcaacggggggcttatggactacgccttccagtacgtgcaggataatgggggtctcgattccgaggaatcctacccctacgaagcaactgaggaatcttgcaagtataaccctaagtattccgtggcaaatgatactggcttcgtggatatccctaaacaggaaaaggccctcatgaaggccgtagccaccgtgggccccatctctgtcgcaattgacgctggtcacgagtctttcctcttctataaggaaggtatatactttgaacccgattgcagcagtgaggacatggatcatggcgtactcgtcgtcgggtatggttttgagagtaccgaatcagataataataaatattggctggtgaaaaacagctggggtgaggagtggggtatgggtggctacgtcaagatggccaaggaccgtaggaaccattgtggtatcgcatctgctgcatcttatcccactgtgtaatagggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 6 - DNA, 1068 bp, Homo sapiens
  Optimized synthetic Cat-L His construct with heterologous signal sequence and restriction sites
gctagcatggacatgcgtgtacctgctcagctgctgggcctgttgctcttgtggcttcccggagcccggggaaccctgacattcgatcactctctggaggcccagtggacaaaatggaaggctatgcacaataggctctacgggatgaatgaggaaggctggagaagggccgtttgggagaagaatatgaaaatgattgagctgcacaaccaggagtaccgagagggaaagcattcctttaccatggcaatgaatgcctttggggacatgacatcagaggagtttcggcaggtgatgaacggatttcagaatagaaagccccgaaaaggcaaagtgttccaagagcccctcttttacgaggccccacgctccgtcgactggcgtgaaaaagggtatgtaactcccgtcaaaaaccagggacagtgcggcagttgttgggccttttctgctaccggggcattggagggccagatgttcaggaagaccggacgtcttatctccctttcagaacagaacctggtcgactgtagcggaccccagggaaacgaggggtgcaatggagggctcatggactatgcatttcagtacgtgcaggacaatggaggcctggattcagaggaatcctacccttacgaggctacagaagaaagctgcaagtataaccctaagtacagcgtcgccaacgacaccgggtttgtcgatattccaaagcaggagaaggccctgatgaaagcagttgccaccgtgggccccatctcagtcgcaattgatgccggccacgagtcttttctgttttataaagaaggtatttactttgagcccgattgcagctctgaagacatggatcacggagtgttggttgtaggctacggcttcgagtccaccgagtcagacaacaataaatactggttggtgaaaaactcctggggggaggagtggggcatgggcggatacgtgaagatggccaaagacagaaggaatcactgtggaatcgcatctgctgccagctatccaactgtaggaggaggcggttcaggtcaccaccaccatcaccactagtgaggatcc

SEQ ID NO: 7 - protein, 350 aa, Homo sapiens [sequence omitted]

SEQ ID NO: 8 - DNA, 6237 bp, Artificial Sequence
  Synthetic Cat-L-His expression vector with heterologous signal sequence
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatggacatgcgtgtacctgctcagctgctgggcctgttgctcttgtggcttcccggagcccggggaaccctgacattcgatcactctctggaggcccagtggacaaaatggaaggctatgcacaataggctctacgggatgaatgaggaaggctggagaagggccgtttgggagaagaatatgaaaatgattgagctgcacaaccaggagtaccgagagggaaagcattcctttaccatggcaatgaatgcctttggggacatgacatcagaggagtttcggcaggtgatgaacggatttcagaatagaaagccccgaaaaggcaaagtgttccaagagcccctcttttacgaggccccacgctccgtcgactggcgtgaaaaagggtatgtaactcccgtcaaaaaccagggacagtgcggcagttgttgggccttttctgctaccggggcattggagggccagatgttcaggaagaccggacgtcttatctccctttcagaacagaacctggtcgactgtagcggaccccagggaaacgaggggtgcaatggagggctcatggactatgcatttcagtacgtgcaggacaatggaggcctggattcagaggaatcctacccttacgaggctacagaagaaagctgcaagtataaccctaagtacagcgtcgccaacgacaccgggtttgtcgatattccaaagcaggagaaggccctgatgaaagcagttgccaccgtgggccccatctcagtcgcaattgatgccggccacgagtcttttctgttttataaagaaggtatttactttgagcccgattgcagctctgaagacatggatcacggagtgttggttgtaggctacggcttcgagtccaccgagtcagacaacaataaatactggttggtgaaaaactcctggggggaggagtggggcatgggcggatacgtgaagatggccaaagacagaaggaatcactgtggaatcgcatctgctgccagctatccaactgtaggaggaggcggttcaggtcaccaccaccatcaccactagtgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 9 - protein, 333 aa, Homo sapiens
  Human Cat-L protein containing heterologous secretory signal
MDPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 10 - DNA, 1002 bp, Homo sapiens
  Sequenced cDNA of Cat-L insert (BATJ)
atggatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtga

SEQ ID NO: 11 - DNA, 6190 bp, Artificial Sequence
  HZ24 expression vector containin Cat-L cDNA
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagccaccatggatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgatgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 12 - protein, 339 aa, Homo sapiens
  Human-Cat-L-His containing heterologous secretory signal
MDPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTVHHHHHH

SEQ ID NO: 13 - DNA, 1020 bp, Homo sapiens
  Encoding human cat-L-His
atggatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgcatcatcatcatcatcattga

SEQ ID NO: 14 - DNA, 6205 bp, Artificial Sequence
  HZ24 expression vector contain Cat-L-His cDNA
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagccaccatggatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgcatcatcatcatcatcattgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 15 - protein, 6 aa, Artificial Sequence
  linker
GGGGSG

SEQ ID NO: 16 - DNA, 42 bp, Artificial Sequence
  Human Cat-L 5' primer
aaggccgctagccaccatggatcctacactcatccttgctgc

SEQ ID NO: 17 - DNA, 35 bp, Artificial Sequence
  Human Cat-L 3' primer
gagcacggatcctcatcacacagtggggtagctgg

SEQ ID NO: 18 - DNA, 49 bp, Artificial Sequence
  Human Cat-L-His primer
cctgccggatcctcaatgatgatgatgatgatgcacagtggggtagctg

SEQ ID NO: 19 - DNA, 952 bp, Homo sapiens
  Pancreatic elastase (PE1; Elastase-1) precursor
ttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtatcacacctgtggagggacccttatcagacagaactgggtgatgacagctgctcactgcgtggattaccagaagactttccgcgtggtggctggagaccataacctgagccagaatgatggcactgagcagtacgtgagtgtgcagaagatcgtggtgcatccatactggaacagcgataacgtggctgccggctatgacatcgccctgctgcgcctggcccagagcgttaccctcaatagctatgtccagctgggtgttctgccccaggagggagccatcctggctaacaacagtccctgctacatcacaggctggggcaagaccaagaccaatgggcagctggcccagaccctgcagcaggcttacctgccctctgtggactacgccatctgctccagctcctcctactggggctccactgtgaagaacaccatggtgtgtgctggtggagatggagttcgctctggatgccagggtgactctgggggccccctccattgcttggtgaatggcaagtattctgtccatggagtgaccagctttgtgtccagccggggctgtaatgtctccaggaagcctacagtcttcacccaggtctctgcttacatctcctggataaataatgtcatcgcctccaactgaacattttcctgagtccaacgaccttcccaaaatggttcttagatctgcaataggacttgcgatcaaaaagtaaaacacattctgaaagactattgagccattgatagaaaagcaaataaaactagatatacatt

SEQ ID NO: 20 - protein, 258 aa, Homo sapiens
  Pancreatic elastase (PE1; Elastase-1) precursor
MLVLYGHSTQDLPETNARVVGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSVHGVTSFVSSRGCNVSRKPTVFTQVSAYISWINNVIASN

SEQ ID NO: 21 - protein, 239 aa, Homo sapiens
  Pancreatic elastase (PE1; Elastase-1) proprotein
VGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSVHGVTSFVSSRGCNVSRKPTVFTQVSAYISWINNVIASN

SEQ ID NO: 22 - DNA, 979 bp, Homo sapiens
  Elastase-2A precursor
cttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaaaaaaaaaaaaaaaaaaaaaaaaaaaaaaaaaataaaaaaaaaaaaaaaaaaaaaaaaaaaaaa

SEQ ID NO: 23 - protein, 269 aa, Homo sapiens
  Elastase-2A precursor
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 24 - protein, 241 aa, Homo sapiens
  Elastase-2A mature
VVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 25 - DNA, 941 bp, Homo sapiens
  Elastase-2B precursor
cttacagaactcccacggacacaccatgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccggttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaaccaaaagaagtccctgggactgtttcagacttggaaaggtcacagaaggaaaataatattatataaagtgacaactatgcaaatcacaaaaaaaaaaaaaaaaaaa

SEQ ID NO: 26 - protein, 269 aa, Homo sapiens
  Elastase-2B precursor
MIRTLLLSTLVAGALSCGVSTYAPDMSRMLGGEEARPNSWPWQVSLQYSSNGQWYHTCGGSLIANSWVLTAAHCISSSRIYRVMLGQHNLYVAESGSLAVSVSKIVVHKDWNSNQVSKGNDIALLKLANPVSLTDKIQLACLPPAGTILPNNYPCYVTGWGRLQTNGALPDDLKQGRLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 27 - protein, 241 aa, Homo sapiens
  Elastase-2B mature
MLGGEEARPNSWPWQVSLQYSSNGQWYHTCGGSLIANSWVLTAAHCISSSRIYRVMLGQHNLYVAESGSLAVSVSKIVVHKDWNSNQVSKGNDIALLKLANPVSLTDKIQLACLPPAGTILPNNYPCYVTGWGRLQTNGALPDDLKQGRLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 28 - DNA, 938 bp, Homo sapiens
  Neutrophil elastase precursor
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaaaaaaaaaaaaaaaa

SEQ ID NO: 29 - protein, 267 aa, Homo sapiens
  Neutrophil elastase precursor
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 30 - protein, 238 aa, Homo sapiens
  Neutrophil elastase mature
IVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 31 - DNA, 1001 bp, Homo sapiens
  Proteinase-3 precursor
cgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 32 - protein, 256 aa, Homo sapiens
  Proteinase-3 precursor
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 33 - protein, 221 aa, Homo sapiens
  Proteinase-3 mature
IVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLR

SEQ ID NO: 34 - DNA, 846 bp, Rattus norvegicus
  endogenous vascular elastase
atgcacagctccgtgtacctcgtggctctggtggtcctggaggcggctgtatgtgttgcgcagccccgaggtcggattctgggtggccaggaggccatggcccatgctcggccctacatggcttcagtgcaagtgaatggcacgcacgtgtgcggtggcaccctggtggatgagcagtgggtgctgagcgccgcgcactgcatggatggagtgaccaaggatgaggttgtgcaggtgctcctgggtgcccactccctgtccagtcctgaaccctacaagcatttgtatgatgtgcaaagtgtagtgcttcacccgggcagccggcctgacagcgttgaggacgacctcatgctctttaagctctcccacaatgcctcactgggtccccatgtgagacccctgcccttgcaacgcgaggaccgggaggtgaaacccggcacgctctgcgatgtggccggttggggcgtggtcactcatgcgggacgcaggcccgatgtcctgcagcaactgacagtgtcaatcatggaccggaacacctgcaatctgcgcacgtaccatgatggggcaatcaccaagaacatgatgtgtgcagagagcaaccgcagggacacttgcaggggcgactccggcggtcctctggtgtgcggggatgcggtcgaagctgtggttacgtggggatctcgagtctgtggcaaccggagaaagccaggtgtctttacccgcgtggcaacctacgtgccgtggattgaaaacgttctgagtggtaacgtgagtgttaacgtgacggcctgaggggacaccggagaccgtgactcacaataaatgcatgcatctaaaaaaaaaaaa

SEQ ID NO: 35 - protein, 262 aa, Rattus norvegicus
  Endogenous vascular elastase precursor
HSSVYLVALVVLEAAVCVAQPRGRILGGQEAMAHARPYMASVQVNGTHVCGGTLVDEQWVLSAAHCMDGVTKDEVVQVLLGAHSLSSPEPYKHLYDVQSVVLHPGSRPDSVEDDLMLFKLSHNASLGPHVRPLPLQREDREVKPGTLCDVAGWGVVTHAGRRPDVLQQLTVSIMDRNTCNLRTYHDGAITKNMMCAESNRRDTCRGDSGGPLVCGDAVEAVVTWGSRVCGNRRKPGVFTRVATYVPWIENVLSGNVSVNVTA

SEQ ID NO: 36 - protein, 238 aa, Rattus norvegicus
  endogenous vascular elastase mature
ILGGQEAMAHARPYMASVQVNGTHVCGGTLVDEQWVLSAAHCMDGVTKDEVVQVLLGAHSLSSPEPYKHLYDVQSVVLHPGSRPDSVEDDLMLFKLSHNASLGPHVRPLPLQREDREVKPGTLCDVAGWGVVTHAGRRPDVLQQLTVSIMDRNTCNLRTYHDGAITKNMMCAESNRRDTCRGDSGGPLVCGDAVEAVVTWGSRVCGNRRKPGVFTRVATYVPWIENVLSGNVSVNVTA

SEQ ID NO: 37 - DNA, 924 bp, Homo sapiens
  Cathepsin G precursor
gcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtactta

SEQ ID NO: 38 - protein, 255 aa, Homo sapiens
  Cathepsin G precursor
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 39 - protein, 235 aa, Homo sapiens
  Cathepsin G mature
IIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 40 - DNA, 784 bp, Homo sapiens
  mast cell chymase precursor
agcatttgctcaggcagcctctctgggaagatgctgcttcttcctctccccctgctgctctttctcttgtgctccagagctgaagctggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcc

SEQ ID NO: 41 - protein, 247 aa, Homo sapiens
  Mast cell chymase precursor
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 42 - protein, 226 aa, Homo sapiens
  Mast cell chymase mature
IIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 43 - DNA, 855 bp, Homo sapiens
  Mast cell tryptase precursor
aggcccacgatgctcctccttgctccccagatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttggactggatccaccactatgtccccaagaagccc

SEQ ID NO: 44 - protein, 242 aa, Homo sapiens
  Mast cell tryptase precursor
MLLLAPQMLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 45 - protein, 205 aa, Homo sapiens
  Mast cell tryptase mature
IVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 46 - DNA, 2732 bp, Homo sapiens
  plasmin precursor
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgcgacatcccccgctgcacaacacctccaccatcttctggtcccacctaccagtgtctgaagggaacaggtgaaaactatcgcgggaatgtggctgttaccgtttccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtgggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggtttt

SEQ ID NO: 47 - protein, 810 aa, Homo sapiens
  plasmin precursor
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 48 - protein, 713 aa, Homo sapiens
  plasmin mature
VYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 49 - DNA, 1997 bp, Homo sapiens
  thrombin precursor
aattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctagagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcacaaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtaggggccactcatattctgggctcctggaaccaatcccgtgaaagaattatttttgtgtttctaaaactatggttcccaataaaagtgactctcagcgg

SEQ ID NO: 50 - protein, 622 aa, Homo sapiens
  thrombin precursor
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 51 - protein, 579 aa, Homo sapiens
  Thrombin mature
ANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 52 - DNA, 955 bp, Homo sapiens
  Granzyme B precursor
ccaagagctaaaagagagtaagggggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaaaaaaaaaaaaaaaaaaaaaaaaaaaaaaa

SEQ ID NO: 53 - protein, 247 aa, Homo sapiens
  Granzyme B precursor
MQPILLLLAFLLLPRADAGEIIGGHEAKPHSRPYMAYLMIWDQKSLKRCGGFLIQDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 54 - protein, 227 aa, Homo sapiens
  Granzyme B mature
IIGGHEAKPHSRPYMAYLMIWDQKSLKRCGGFLIQDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 55 - DNA, 4100 bp, Homo sapiens
  Cathepsin S precursor
gtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaa

SEQ ID NO: 56 - protein, 331 aa, Homo sapiens
  Cathepsin S precursor
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 57 - protein, 217 aa, Homo sapiens
  Cathepsin S mature
LPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 58 - DNA, 1702 bp, Homo sapiens
  Cathepsin K precursor
aaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacat

SEQ ID NO: 59 - protein, 329 aa, Homo sapiens
  Cathepsin K precursor
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 60 - protein, 215 aa, Homo sapiens
  Cathepsin K mature
APDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 61 - DNA, 1731 bp, Homo sapiens
  Cathepsin L precursor
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacagttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaaaaaaaaaaaaaaaaaa

SEQ ID NO: 62 - protein, 333 aa, Homo sapiens [sequence omitted]

SEQ ID NO: 63 - DNA, 3783 bp, Homo sapiens
  Cathepsin B precursor
ggggcggggccgggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 64 - protein, 339 aa, Homo sapiens
  cathepsin B precursor
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 65 - protein, 260 aa, Homo sapiens
  cathepsin B mature
  cathepsin B light chain 1-47
  cathepsin B heavy chain 48-254
LPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 66 - DNA, 1399 bp, Homo sapiens
  cathepsin H precursor
ttgccggcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcaatcgccatcgcaaccggaaagatgctgtccttggcggaacagcagctggtggactgcgcccaggacttcaataattacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctcca

SEQ ID NO: 67 - protein, 335 aa, Homo sapiens [sequence omitted]

SEQ ID NO: 68 - protein, 238 aa, Homo sapiens
  cathepsin H mature
EPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 69 - DNA, 1975 bp, Mus musculus
  cathepsin F precursor
cggtgcccattggccgccccggcgttctccaacgttgtagggaaactctctgtggcctctgacagcaggctccgcctcgggtctcttgatccgtgtgtttgtgggtcagtgaatccgggcgagcagcttcgacctcgctatggcgcccctactgcagcttctgtggctgctgacactgctctcgactgtggccctgagccccgtccccgccaagccctgggcagatgacgagcaggcctggaacttgtcgtcccaggagctgctggcccccgcccgcttcgcgctggacatgtacaattacggccgtgctgcggggacaagggccgtgctaggagcggtgcgcggacgcgtccgccgggccggccagggctctctgttctccctggaagccacactagaggagccaccttgcaatgatcccctggtgtgcccactgcctgagacgaagaaaacagtgctctgcagttttgaagtcctggaagagctaaaagaacacttgctgctgaggagggactgtagcccagtgaatgccaaggtcacagagtttagaaatgcgactttcagctcattccttccattgttggacaaggatcccctgccccaggacttctctgtgaagatggctccactcttcaaggacttcatgaccacctataaccggacttatgaatcaagggaagaagcccagtggcgattgactgtctttgcaagaaatatgatacgagcacagaagattcaggccctggaccgcggcacagctcagtatgggatcaccaagttcagtgacctcacagaggaggaattccacaccatctacctgaatcccctcttacagaaggagtctggcaggaagatgagtccagccaagtccataaatgatcttgccccgcctgaatgggactggaggaagaaaggggctgtcactgaagtgaagaaccagggcatgtgtggctcctgctgggccttttctgtcacaggcaacgtggagggccagtggttcctgaaccgggggactctgctctccctgtcagagcaggagctcttggattgtgacaaggtggacaaggcctgcttgggtggattgccctccaacgcctatgcagccataaagaatttgggagggctggagacagaggatgactacggctaccagggccatgttcagacctgcaacttctcagcacagatggcaaaagtctacatcaatgattcagtggagctgagccggaatgaaaataagatagcagcctggctggcccagaaaggacctatctcagttgccattaacgccttcggcatgcagttctatcgccacgggattgctcacccattccggcccctctgcagcccttggttcatcgaccatgctgtgttgctggtgggctatggcaaccgctctaacattccttactgggccatcaagaacagctggggcagtgactggggtgaggagggttactactacttgtaccgtggatctggagcctgtggtgtgaataccatggccagctcagccgtggtgaactgagagttgctggctcaggacctatgttgtcacagtggccccttccttagcccgactcatgcccaggcccttcctcacgagacagagctggttggctgagggccgggcactttggacctcacggtgagccctgggccctgggccccttcgtccctctttcctctagtgctcatctgaagttccccagctgcacctgtgtccgattgtggtagctaggaggatcctgaggtgcaggaggctttcatggaagccagcgccggggcaagaacctggctacagtatgatgcaggatgaaaatatgctcgtcataaaactagatctgtcctcagcaggctctgtctttttgctttggtgctcctcggtctgatgctgtcagttttctggtccctttccacatccaggaaagttgtgaccggccttctctaagggcaataaagaggtagcctgctc

SEQ ID NO: 70 - protein, 462 aa, Mus musculus
  cathepsin F precursor
MAPLLQLLWLLTLLSTVALSPVPAKPWADDEQAWNLSSQELLAPARFALDMYNYGRAAGTRAVLGAVRGRVRRAGQGSLFSLEATLEEPPCNDPLVCPLPETKKTVLCSFEVLEELKEHLLLRRDCSPVNAKVTEFRNATFSSFLPLLDKDPLPQDFSVKMAPLFKDFMTTYNRTYESREEAQWRLTVFARNMIRAQKIQALDRGTAQYGITKFSDLTEEEFHTIYLNPLLQKESGRKMSPAKSINDLAPPEWDWRKKGAVTEVKNQGMCGSCWAFSVTGNVEGQWFLNRGTLLSLSEQELLDCDKVDKACLGGLPSNAYAAIKNLGGLETEDDYGYQGHVQTCNFSAQMAKVYINDSVELSRNENKIAAWLAQKGPISVAINAFGMQFYRHGIAHPFRPLCSPWFIDHAVLLVGYGNRSNIPYWAIKNSWGSDWGEEGYYYLYRGSGACGVNTMASSAVVN

SEQ ID NO: 71 - protein, 214 aa, Mus musculus
  cathepsin F mature
APPEWDWRKKGAVTEVKNQGMCGSCWAFSVTGNVEGQWFLNRGTLLSLSEQELLDCDKVDKACLGGLPSNAYAAIKNLGGLETEDDYGYQGHVQTCNFSAQMAKVYINDSVELSRNENKIAAWLAQKGPISVAINAFGMQFYRHGIAHPFRPLCSPWFIDHAVLLVGYGNRSNIPYWAIKNSWGSDWGEEGYYYLYRGSGACGVNTMASSAVVN

SEQ ID NO: 72 - DNA, 3453 bp, Mus musculus
  cathepsin O precursor
gaaaccgaaagagaaagcgggccgggcacagtggacctcgggcaccgggatgaagccgcagttggtgaacctcttgctactgtgttgctgctgtctcggccgccacggggtcgccgggacctggtcttggagccaccagcgggaggccgccgccttgcgggaaagccttcatagacaccgatacttgaactcttttcctcatgaaaactccactgccttctatggagtaaatcagttttcttatttgtttcctgaagagtttaaagctttgtatttaggcagcaaatatgcctgggctcccagatacccagcagaaggacagagacctatccccaatgtgtctttgccattgagatttgactggagggacaagcatgttgtgaatcctgtaaggaaccaggagatgtgtggaggatgctgggccttcagcgtggtgagtgccatagagtcagctcgtgcaatccaagggaaatctctggattacctgagcgtgcagcaggtcatcgactgctcctttaataattctggctgcctcggtggctctcctctctgtgccttgcgctggctaaatgagacacagttgaagttggtggcagattcacagtacccattcaaggcagtaaatggccagtgtcgccactttcctcaatcacaagctggagtttcagtcaaggatttttctgcatataacttcaggggccaagaggatgaaatggccagagcacttctgtccttcggccctttggttgtgatagttgatgcgatgagctggcaggattatctggggggcataatccaacatcactgctccagtggggaggccaaccatgccgttctcatcacaggctttgataggacaggaaatacaccatattggatggtgcgaaactcctggggatcctcctggggagtagaaggctatgcccacgtgaaaatgggaggtaatgtttgtggcattgcagactctgtagctgctgtctttgtgtgatcatgaattgttttggattcaccatgagacaactacgaaaatgatgcacttcatagtgtgatccaacatcatactcaactctaagcattatgcaccttcaagttccaacaatttgtctacagagaggttctaagagcaaactggcattttgtaaagcaacctaggacattctattttttgcaaagacatggacagccaaacttcataggaaatccccaggacgttgactgatcaacggactctgtgggatagtgtgcacctctgagagtttggtgggatcagaagtcacatagtattctcctcctggaagcagttgggacttttgcttgcttgttgtctttctggctgtctacattaaggaagtattttggtcagggtgaattgaagatatgatgagcctttgtttttcccttgtgacttataatcaccagtcttagattacctcatctacaagaactctcaacctgatgcaatgtgtgcctcataattagaatggccttctgttccatgtgaacagatttggaatatcagttgttttatttcagcaaatggaacttactctagacagtagaacaaatgtgcaccaagatgaaacaacgatgcacaaagagaatcccatcttcagagagacaatccaactggagttaaataaacacgtgacaacagtgtgataaggagtacactatgccacttccagggagtcatgatgtctataaagcttcacttttaaacacccaaaatgtttagcttcttgccttcttccctctgaggtagagaatgaagtattgtccacatttattccctctcttgtcctttatggtacaagtcctatggtttcctggtggtttaccttccagtccaaagtaactcagtaccgttggttgtattccatttctgttacccaatctcttacttaaaaacaaaatctctgacacaggctcacattgctccttgtttatgtccttcattagaataccagcatcaataacaaagctccttactcttttgtctgtaccagtgagaagcaatcttgaatgtgcagatcatggagggtaaagaaacggcagaagacatttcttaaggttttgaataaagtagcctaattatcgaaggaatccaggaaggaatgtagttcagctatagtgtttcttaatgactttcattatgttatcagcaatgtttctaatacccagtttcaaatgcagataaacttgaaattttcaaaatcactgttactctttaagtattctggattgataacatttataataatacaacctacatttgactttgaattaaaagtaacttattcttaaatatgtagtctatgatttattattatttatgagcactaatagatatttattagtatcgataagctttatatttacattttcttggatttgaacccttatatccaatgtgcttttctccatagatgattttaattccaccatgtccaagattcctctcatcatcttcccatatctgttgtcaatgctcagtggtcctcttctccttaccttttctttctgtcagcagcattgctattgtataagcaggccatagagtcaaaaggaattctagacaatcaagttgtctcctccttagaacccattcctacatctgtctccatcctctctttcacgcatcctttctgggaggtacactttttattatctcctatctacactcttcagttgtttccagccaacctaaaataaaaagggagatatcttcataaaagtttaggttttttttttgtttgtttgtttgtttggttggcttttgtcttttatttttgtatagagttatgatgagttttgatgtgatgcacttcaaacactttttgtgatagtttttgttatgtatcaattatatgtaacactccctttcagtgacttgttagctttattcctttcgttttcttgttagtgcctggtgtaagtaactccctatggttctgacaacctttattagtaactaaactatgtgacctttaacacagtaggtcctgaacagtaatctccagagcagaacagatggctttgaaagatgctactataatgtgtcctatatttccccagatttatatttctaaaatgatgttatcattttactcacaagttttacagcactggaaatcagtaagataacatgcaaattttttcaaataagcattatggagaggtctctctctacctttgtatcccctgtaaataagtgatgacgcatatacaccagctcatgggtgctcctgccccagaaaaccagagacagagcagccgaatgtgttccttactacacagcattcatactgaagatcaccaacaggtcctgaaagtgatttgacaaggtccccattgcaactgttaaatgggtcaactttgcagtgcctttgaaatatcccatcacttgggaggcagaggcaggtgaatttctgaggtcaaggccagcccccccac

SEQ ID NO: 73 - protein, 312 aa, Mus musculus
  cathepsin O precursor
MKPQLVNLLLLCCCCLGRHGVAGTWSWSHQREAAALRESLHRHRYLNSFPHENSTAFYGVNQFSYLFPEEFKALYLGSKYAWAPRYPAEGQRPIPNVSLPLRFDWRDKHVVNPVRNQEMCGGCWAFSVVSAIESARAIQGKSLDYLSVQQVIDCSFNNSGCLGGSPLCALRWLNETQLKLVADSQYPFKAVNGQCRHFPQSQAGVSVKDFSAYNFRGQEDEMARALLSFGPLVVIVDAMSWQDYLGGIIQHHCSSGEANHAVLITGFDRTGNTPYWMVRNSWGSSWGVEGYAHVKMGGNVCGIADSVAAVFV

SEQ ID NO: 74 - protein, 214 aa, Mus musculus
  cathepsin O mature
LPLRFDWRDKHVVNPVRNQEMCGGCWAFSVVSAIESARAIQGKSLDYLSVQQVIDCSFNNSGCLGGSPLCALRWLNETQLKLVADSQYPFKAVNGQCRHFPQSQAGVSVKDFSAYNFRGQEDEMARALLSFGPLVVIVDAMSWQDYLGGIIQHHCSSGEANHAVLITGFDRTGNTPYWMVRNSWGSSWGVEGYAHVKMGGNVCGIADSVAAVFV

SEQ ID NO: 75 - DNA, 1335 bp, Mus musculus
  cathepsin R precursor
agcaacttttgaagagttgagtctgtggagtggattgaggcagaggcagtcacctcaggtacttgagacatggctgctgttgtcttcatagccttcctgtatttgggagtggcctcaggtgttccagtacttgattcaagtttggatgctgaatggcaagactggaagataaagtataacaaatcatatagcctgaaggaagaaaaactgaagagagtggtttgggaagaaaaattgaaaatgatcaaactacacaacagggagaacagcctgggtaagaatggcttcaccatgaaaatgaatgaatttggtgaccagactgatgaagaattcaggaaaatgatgattgaaatttcagtttggactcacagagaggggaaaagtatcatgaaacgggaagctggcagtattctccccaaatttgtcgattggcgaaagaaaggatatgtgactcctgtacggagacagggagattgtgatgcttgttgggcatttgctgtgactggtgccatagaagcacaggcaatctggcaaacgggcaaactcacccctctgagtgtgcagaacctggtggactgttctaaacctcaaggcaacaatggttgtcttggtggtgatacatacaatgccttccagtatgttttgcacaatggtggtctggagtctgaggcaacatatccatatgaagggaaagatggaccatgcaggtataatccaaagaattctaaggctgaaatcacaggatttgtgtccctcccccaaagtgaggatatcctaatggctgctgtagcaactattgggcccatcactgctggaattgatgcttcacatgagtctttcaagaactataagggaggtatttaccatgagccaaattgtagcagtgatactgtgactcatggagtcctcgtggttggttacggatttaagggaattgagaccgatggtaatcactactggctgatcaagaatagctggggtaaacgatggggcattagaggctacatgaagctcgccaaagacaagaacaaccactgtggaattgcttcatatgctcactaccctactatttgagcaacctggtggccacaaggaaggttttggcacaagacagcatttctaggggagggctatctgctagtcagcgaccagcctttgcttggtatattcaagacttgtgtccctgaagagcaaccttgtaatgtgattctgggacccttcaactattttgacatcatgaacactattgctctaactaacgtatgtttattattccttcaaaaaaatcagctttaccgattgtgcaaataaaatcctttaaaaaataaaatgcaa

SEQ ID NO: 76 - protein, 334 aa, Mus musculus
  cathepsin R precursor
MAAVVFIAFLYLGVASGVPVLDSSLDAEWQDWKIKYNKSYSLKEEKLKRVVWEEKLKMIKLHNRENSLGKNGFTMKMNEFGDQTDEEFRKMMIEISVWTHREGKSIMKREAGSILPKFVDWRKKGYVTPVRRQGDCDACWAFAVTGAIEAQAIWQTGKLTPLSVQNLVDCSKPQGNNGCLGGDTYNAFQYVLHNGGLESEATYPYEGKDGPCRYNPKNSKAEITGFVSLPQSEDILMAAVATIGPITAGIDASHESFKNYKGGIYHEPNCSSDTVTHGVLVVGYGFKGIETDGNHYWLIKNSWGKRWGIRGYMKLAKDKNNHCGIASYAHYPTI

SEQ ID NO: 77 - protein, 220 aa, Mus musculus
  cathepsin R mature
LPKFVDWRKKGYVTPVRRQGDCDACWAFAVTGAIEAQAIWQTGKLTPLSVQNLVDCSKPQGNNGCLGGDTYNAFQYVLHNGGLESEATYPYEGKDGPCRYNPKNSKAEITGFVSLPQSEDILMAAVATIGPITAGIDASHESFKNYKGGIYHEPNCSSDTVTHGVLVVGYGFKGIETDGNHYWLIKNSWGKRWGIRGYMKLAKDKNNHCGIASYAHYPTI

SEQ ID NO: 78 - DNA, 1327 bp, Homo sapiens
  cathepsin W precursor
tgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccggcgccatctcacccatcaaggaccagaaaaactgcaactgctgctgggccatggcagcggcaggcaacatagagaccctgtggcgcatcagtttctgggattttgtggacgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagacctctgaaaaaaaaaaaaaaaaaaaaaaaaaaaaaaa

SEQ ID NO: 79 - protein, 376 aa, Homo sapiens
  cathepsin W precursor
MALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVAGAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 80 - protein, 249 aa, Homo sapiens
  cathepsin W mature
VPFSCDWRKVAGAISPIKDQKNCNCCWAMAAAGNIETLWRISFWDFVDVSVHELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 81 - DNA, 3007 bp, Homo sapiens
  calpain 1 large subunit precursor
aaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccattgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtg

SEQ ID NO: 82 - protein, 714 aa, Homo sapiens
  calpain 1 large subunit
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 83 - DNA, 3492 bp, Homo sapiens
  calpain 2 large subunit precursor
caggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaaaaaa

SEQ ID NO: 84 - protein, 700 aa, Homo sapiens
  calpain 2 large subunit precursor
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 85 - protein, 699 aa, Homo sapiens
  calpain 2 large subunit
AGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 86 - DNA, 1492 bp, Homo sapiens
  calpain small subunit 1
cgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaa

SEQ ID NO: 87 - protein, 268 aa, Homo sapiens
  calpain small subunit 1
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQEWLQLTMYS

SEQ ID NO: 88 - DNA, 2205 bp, Homo sapiens
  cathepsin D precursor
gcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 89 - protein, 412 aa, Homo sapiens
  cathepsin D precursor
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 90 - protein, 348 aa, Homo sapiens
  cathepsin D mature
GPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 91 - DNA, 2228 bp, Homo sapiens
  cathepsin e transcript variant 1
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 92 - protein, 396 aa, Homo sapiens
  cathepsin E isoform a precursor
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 93 - protein, 343 aa, Homo sapiens
  cathepsin E isoform a mature
IQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 94 - DNA, 2086 bp, Homo sapiens
  cathepsin E  transcript variant 2
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 95 - protein, 363 aa, Homo sapiens
  cathepsin E isoform B precursor
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 96 - protein, 310 aa, Homo sapiens
  cathepsin E isoform b mature
IQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 97 - DNA, 1973 bp, Homo sapiens
  MMP-1 precursor
gggatattggagtagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 98 - protein, 469 aa, Homo sapiens
  MMP-1 precursor
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 99 - protein, 370 aa, Homo sapiens
  MMP-1 mature
FVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 100 - DNA, 2223 bp, Homo sapiens
  MMP-8 precursor
gctcgccagggaagggccctacccagaggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagagcatagccacctaggggaggaggccgtgtgaagacagaggcagagattggagtgacgcatctccaagccaa

SEQ ID NO: 101 - protein, 467 aa, Homo sapiens [sequence omitted]

SEQ ID NO: 102 - protein, 367 aa, Homo sapiens
  MMP-8 mature
LTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVEMNFISLFWPSLPTGIQAAYEDFDRDLIFLFKGNQYWALSGYDILQGYPKDISNYGFPSSVQAIDAAVFYRSKTYFFVNDQFWRYDNQRQFMEPGYPKSISGAFPGIESKVDAVFQQEHFFHVFSGPRYYAFDLIAQRVTRVARGNKWLNCRYG

SEQ ID NO: 103 - DNA, 2722 bp, Homo sapiens
  MMP-13 precursor
caacagtccccaggcatcaccattcaagatgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagccatacataaaagaaataaaccaaaggaaaatgtctgtaataatagactgtaacttccaaataaataattttcattttgcactgaggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccggtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgataaaaactcaggcaaagaaaatgaaatgcatatttgcaaagtgtattaggaagtgtttatgttgtttataataaaaatatattttcaacagaaaaaaaa

SEQ ID NO: 104 - protein, 471 aa, Homo sapiens
  MMP-13 precursor
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 105 - protein, 368 aa, Homo sapiens
  MMP-13 mature
YNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 106 - DNA, 1609 bp, Xenopus laevis
  MMP-18
accttcaaatcctagaaagccttagaagaatgaacagcctcctgctaaagctgctactatgtgtagccattactgctgccttcccagcagataaacaagatgagcccccagcaacaaaggaagaaatggcagagaattacttgaagagattttacagtcttggaactgatgggggaccagttggaagaaagaaacacatccaacctttcactgaaaagctcgagcagatgcagaagttttttggcttaaaggtgacaggaacattggaccccaagactgtagaagtaatggagaaacccagatgtggagtctatgatgttggccagtacagcacagtcgcaaaaagttctgcatggcagaagaaggatctgacctacagaattctaaacttcactcctgacctgcctcaggctgatgtggagactgccatacaaagagctttcaaagtctggagtgacgtgacacctttgacctttaccagaatctacaatgaagtatcagatatagaaatctcctttacagctggagatcacaaagacaattctccttttgatggatctggtggcattttggcccatgcctttcagcccggcaatggcattggtggagatgcccattttgatgaagatgaaacctggacaaagaccagtgaaatatacaatctgtttcttgttgctgctcatgaatttggacactcgctggggctttctcattccactgatcagggtgctttgatgtatccaacatactcaaataccgaccccaagacatttcagcttcctcaagatgatatcaatgctatacagtatctatatggaaaatcctccaatccagtccaaccaaccggaccatccactccttccagatgtgatccaaatgttgttttcaatgctgtcaccaccatgagaggagaactgattttctttgtgaagaggtttttatggaggaagcatccccaagcatccgaggctgaactcatgtttgttcaagcattctggccatcgctgcccactaatattgatgcggcgtatgaaaatcctataacggagcagatccttgtgtttaaaggatcaaaatatacagctctggacggcttcgatgtagtacaaggttaccccaggaacatctacagcctgggatttccaaagaccgtgaaaagaattgatgcggctgttcatattgaacaactagggaaaacatatttctttgcagctaagaaatactggagttatgatgaagataaaaaacaaatggacaaaggctttccaaagcaaataagcaacgatttcccgggaattcctgataaaattgatgcagctttttattacagaggccgcctgtatttcttcattggaaggagccagtttgaatacaatatcaactctaaaagaatcgtacaggtcttaagaagcaacagctggttgggctgttaataagacggaccccaagctctgtaacaagggcaacgatgaatgtgatggcagctcatttctgcacctgccgtgtgaccaatattatttaaaatcatttcctttgaatgtttgactttatttaatctttatgaattaatattttgtactcatgttgttttaataaaaacgttttgttt

SEQ ID NO: 107 - protein, 467 aa, Xenopus laevis
  MMP-18
MNSLLLKLLLCVAITAAFPADKQDEPPATKEEMAENYLKRFYSLGTDGGPVGRKKHIQPFTEKLEQMQKFFGLKVTGTLDPKTVEVMEKPRCGVYDVGQYSTVAKSSAWQKKDLTYRILNFTPDLPQADVETAIQRAFKVWSDVTPLTFTRIYNEVSDIEISFTAGDHKDNSPFDGSGGILAHAFQPGNGIGGDAHFDEDETWTKTSEIYNLFLVAAHEFGHSLGLSHSTDQGALMYPTYSNTDPKTFQLPQDDINAIQYLYGKSSNPVQPTGPSTPSRCDPNVVFNAVTTMRGELIFFVKRFLWRKHPQASEAELMFVQAFWPSLPTNIDAAYENPITEQILVFKGSKYTALDGFDVVQGYPRNIYSLGFPKTVKRIDAAVHIEQLGKTYFFAAKKYWSYDEDKKQMDKGFPKQISNDFPGIPDKIDAAFYYRGRLYFFIGRSQFEYNINSKRIVQVLRSNSWLGC

SEQ ID NO: 108 - protein, 368 aa, Xenopus laevis
  MMP-18 mature
YSTVAKSSAWQKKDLTYRILNFTPDLPQADVETAIQRAFKVWSDVTPLTFTRIYNEVSDIEISFTAGDHKDNSPFDGSGGILAHAFQPGNGIGGDAHFDEDETWTKTSEIYNLFLVAAHEFGHSLGLSHSTDQGALMYPTYSNTDPKTFQLPQDDINAIQYLYGKSSNPVQPTGPSTPSRCDPNVVFNAVTTMRGELIFFVKRFLWRKHPQASEAELMFVQAFWPSLPTNIDAAYENPITEQILVFKGSKYTALDGFDVVQGYPRNIYSLGFPKTVKRIDAAVHIEQLGKTYFFAAKKYWSYDEDKKQMDKGFPKQISNDFPGIPDKIDAAFYYRGRLYFFIGRSQFEYNINSKRIVQVLRSNSWLGC

SEQ ID NO: 109 - DNA, 3546 bp, Homo sapiens
  MMP-2
gcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagagaaaaaaaaaaa

SEQ ID NO: 110 - protein, 660 aa, Homo sapiens
  MMP-2 precursor
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 111 - protein, 551 aa, Homo sapiens
  MMP-2 mature
YNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 112 - DNA, 2387 bp, Homo sapiens
  MMP-9
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaaaaaaaaaaaaaaaaaaaaaaaaaaaaaaaaaaaaaaaaa

SEQ ID NO: 113 - protein, 707 aa, Homo sapiens
  MMP-9 precursor
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 114 - protein, 614 aa, Homo sapiens
  MMP-9 mature
MRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 115 - DNA, 1828 bp, Homo sapiens
  MMP-3
ctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttattttatctt

SEQ ID NO: 116 - protein, 477 aa, Homo sapiens
  MMP-3 precursor
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 117 - protein, 378 aa, Homo sapiens
  MMP-3 mature
FRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 118 - DNA, 1743 bp, Homo sapiens
  MMP-10
aaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctctttcgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttcctt

SEQ ID NO: 119 - protein, 476 aa, Homo sapiens
  MMP-10 precursor
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 120 - protein, 378 aa, Homo sapiens
  MMP-10 mature
FSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 121 - DNA, 2247 bp, Homo sapiens
  MMP-11
ccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctgcagggggatggggtggggtacaaccaccatgacaactgccgggagggccacgcaggtcgtggtcacctgccagcgactgtctcagactgggcagggaggctttggcatgacttaagaggaagggcagtcttgggacccgctatgcaggtcctggcaaacctggctgccctgtctcatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttct

SEQ ID NO: 122 - protein, 488 aa, Homo sapiens
  MMP-11 precursor
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 123 - protein, 391 aa, Homo sapiens
  MMP-11 mature
FVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 124 - DNA, 1147 bp, Homo sapiens
  MMP-7
accaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttaaaaaaaaaaaaaaaaaaaaaaaaaaaaa

SEQ ID NO: 125 - protein, 267 aa, Homo sapiens
  MMP-7 precursor
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 126 - protein, 173 aa, Homo sapiens
  MMP-7 mature
YSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 127 - DNA, 998 bp, Homo sapiens
  MMP-26
gacaaatgagggtttggcatgcagctcgtcatcttaagagttactatcttcttgccctggtgtttcgccgttccagtgccccctgctgcagaccataaaggatgggactttgttgagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagtaaaaaaaaa

SEQ ID NO: 128 - protein, 261 aa, Homo sapiens
  MMP-26 precursor
MQLVILRVTIFLPWCFAVPVPPAADHKGWDFVEGYFHQFFLTKKESPLLTQETQTQLLQQFHRNGTDLLDMQMHALLHQPHCGVPDGSDTSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 129 - protein, 172 aa, Homo sapiens
  MMP-26 mature
TSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 130 - DNA, 1825 bp, Homo sapiens
  MMP-12
agaaaggaacacagtaaactgaattgatccgtttagaagtttacaatgaagtttcttctaatactgctcctgcaggccactgcttctggagctcttcccctgaacagctctacaagcctggaaaaaaataatgtgctatttggtgaaagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatgtccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcaccaacttgttcctcactgctgttcacgagattggccattccttaggtcttggccattctagtgatccaaaggccgtaatgttccccacctacaaatatgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaattatacttacttctggcataactaaaattaagtatatatattttggctcaaataaaattgaaaaaaaaatca

SEQ ID NO: 131 - protein, 470 aa, Homo sapiens
  MMP-12 precursor
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 132 - protein, 365 aa, Homo sapiens
  MMP-12 mature
GPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 133 - DNA, 3558 bp, Homo sapiens
  MMP-14
cagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgctcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccaaaaaaaaaaaaaaaaaaaaa

SEQ ID NO: 134 - protein, 582 aa, Homo sapiens
  MMP-14 precursor
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 135 - protein, 471 aa, Homo sapiens
  MMP-14 mature
YAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 136 - DNA, 4456 bp, Homo sapiens
  MMP-15
acgactctttgatccctcccctaagacctccttcccgtccgcctaggcctcggtatcccccaccaggtatgagaaggaggagtcttcattcttcccaggcggggagaccacgccttccctgcctcctccctccgcggggggtcgcgttggaggtcacccccgccccctaggcgctgggttgggagtgacgcggggtgggctggagaggtttcctgccgtctgggaagcgtaaacggaccgcccacctgtcgggcctcggccgcccgcacctgcttgtgagaagcctgcggctggggcaccgcccccggtccccgcccgggtccgcgcattgggagcacactggccctttaagagcgcggcggccgcggcgcgcggggaggagggctgggagcgcccggagccgcgctgaactcgccggggacgtcgggcgcccgctccttggctggctcgcttgctctctcgctcgctctctcgggtcggctccctgcgcctcctcccgggactgcttggggacccgggcccggtcgggcgcggcggcgagcagaatccccgtgcaggaggcgcgcgctccgggcagcgcccggccccgggcatggacagagggagctgggcgcgcagggagcgccgcgggaccgggcggccggagcgctgagccagacaaaggctccggagttgcgcttgctctcgggagccgggccccaggcgctgggcgccgaggctgcggaacctcgccgggggcagctccggtcggccccctttcccgccggctggttccgagctcccggacctgccctgcccgcttctcctcgggcttgggaatttgccgaggcgacctaggcggctccggcggggaccgggagcccgaggtccgcggcgcgcctgccgggccaggagccagggagcgtcgcaagtttccaaggcgcgtgcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacacctccttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaaaaaaaaaaaaaaaaaaaa

SEQ ID NO: 137 - protein, 669 aa, Homo sapiens
  MMP-15 precursor
MGSDPSAPGRPGWTGSLLGDREEAARPRLLPLLLVLLGCLGLGVAAEDAEVHAENWLRLYGYLPQPSRHMSTMRSAQILASALAEMQRFYGIPVTGVLDEETKEWMKRPRCGVPDQFGVRVKANLRRRRKRYALTGRKWNNHHLTFSIQNYTEKLGWYHSMEAVRRAFRVWEQATPLVFQEVPYEDIRLRRQKEADIMVLFASGFHGDSSPFDGTGGFLAHAYFPGPGLGGDTHFDADEPWTFSSTDLHGNNLFLVAVHELGHALGLEHSSNPNAIMAPFYQWKDVDNFKLPEDDLRGIQQLYGTPDGQPQPTQPLPTVTPRRPGRPDHRPPRPPQPPPPGGKPERPPKPGPPVQPRATERPDQYGPNICDGDFDTVAMLRGEMFVFKGRWFWRVRHNRVLDNYPMPIGHFWRGLPGDISAAYERQDGRFVFFKGDRYWLFREANLEPGYPQPLTSYGLGIPYDRIDTAIWWEPTGHTFFFQEDRYWRFNEETQRGDPGYPKPISVWQGIPASPKGAFLSNDAAYTYFYKGTKYWKFDNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLYCKRSLQEWV

SEQ ID NO: 138 - protein, 529 aa, Homo sapiens
  MMP-15 mature
YALTGRKWNNHHLTFSIQNYTEKLGWYHSMEAVRRAFRVWEQATPLVFQEVPYEDIRLRRQKEADIMVLFASGFHGDSSPFDGTGGFLAHAYFPGPGLGGDTHFDADEPWTFSSTDLHGNNLFLVAVHELGHALGLEHSSNPNAIMAPFYQWKDVDNFKLPEDDLRGIQQLYGTPDGQPQPTQPLPTVTPRRPGRPDHRPPRPPQPPPPGGKPERPPKPGPPVQPRATERPDQYGPNICDGDFDTVAMLRGEMFVFKGRWFWRVRHNRVLDNYPMPIGHFWRGLPGDISAAYERQDGRFVFFKGDRYWLFREANLEPGYPQPLTSYGLGIPYDRIDTAIWWEPTGHTFFFQEDRYWRFNEETQRGDPGYPKPISVWQGIPASPKGAFLSNDAAYTYFYKGTKYWKFDNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLY

SEQ ID NO: 139 - DNA, 6347 bp, Homo sapiens
  MMP-16
tctttgagccggaaccgccggtgaacttaggcgccacgttcccggtgactgaccccggaggatggtgaacaggaactactgctgaccctgtcttcgccgctgcctctcgggggctgccgagcgcggggcccctgtctcctccccttgcccggctgtgggtgaacctgcaggctccttacccacccggaggacttttttttgaaaggaaacgagggagggagggagagggagagagggagaaaacgaaggggagctcgtccatccattgaagcacagttcactatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaaggtaacaaatattgggtgttcaaggatacaactcttcaacctggttaccctcatgacttgataacccttggaagtggaattccccctcatggtattgattcagccatttggtgggaggacgtcgggaaaacctatttcttcaagggagacagatattggagatatagtgaagaaatgaaaacaatggaccctggctatcccaagccaatcacagtctggaaagggatccctgaatctcctcagggagcatttgtacacaaagaaaatggctttacgtatttctacaaaggaaaggagtattggaaattcaacaaccagatactcaaggtagaacctggatatccaagatccatcctcaaggattttatgggctgtgatggaccaacagacagagttaaagaaggacacagcccaccagatgatgtagacattgtcatcaaactggacaacacagccagcactgtgaaagccatagctattgtcattccctgcatcttggccttatgcctccttgtattggtttacactgtgttccagttcaagaggaaaggaacaccccgccacatactgtactgtaaacgctctatgcaagagtgggtgtgatgtagggttttttcttctttctttcttttgcaggagtttgtggtaacttgagattcaagacaagagctgttatgctgtttcctagctaggagcaggcttgtggcagcctgattcggggctgacctttcaaacccagagggttgctggtcctgcacatgagtggaaatacactcatggggaagcttccatgatgcacagtatctgctgttcttcagtcctttgtctttctttgtcattcagttctaggcctttcctctgcacgctcaatgcccagtaaaatttcaggattaactaaagaagaggagaaaaagaagaaaagattcttcttaaaagtttctaatgttattttccttctgaagtctgagcccatttctggggggagaaaaaaaaagcaaatcagaaaacccacggtttttctttttttctttttttctttttttctttttttgctttaaaacaaagggaaaaaagagtttaaacaaaaaacccacaattgaacttccaggaaagtgtgaagacccaaaacagctttgtctccaaagaagatagctctctgactgctttggatagtctcctacgcaccattttgtcaggtgggagatttggaatacacatgcaggacgttagactgttgggacagccattttccaacaaccaaggggccaaaatatctgcaatatagtaacagccttaataatacatccatttttcgttttatacagctgttctcagctatgtcctcagtgtttcatcgcatttatattcatagctattttcaaacacgaccttttaattgtttttgaagtatttctaaaccccttctttccaccttactcctccatcattgtgataatcttcccaagttgtattaggccattgccccaggccttccatgggtctgtcaggaatattcgttacaaagcagagcaagaagcagtatgtctctgaagtggattacagtggcagttattttacaaggatttgtgacactagtaacatacccgtgtaaccctttgagaactatcagaccagctttcagagtcttaggattgtcggtcttgcgatctgataaattatagaactgggcaatggtaaaaacagtcacaagttcaagaagttcaggtttttaaaacagatatcctataatgtcatataatttttaaatgatttacaagactacataaatgtgtttataacaaacagaaatgatgttacttgccaaaatttttctggcaaataaaaaaggtattttattaagattctcataaatctgaaattttatttgaaaaactgataatagcctaagtcttcttttcttttttttaggcatactgaatttctgttttaaaatccattgcatgaaaattcaatttgccttggtatatgcagttagcattgccattttaaaaatgaattaaaacggtgactctgaagttgcatgaatatcctccagtgcattacctattgcatgtccaccatagttctcaaagggttagtgtggcttctggcatttagccgtccatttgatcactgacagagccaagagaccaccaaagcatttcattgttgagtgtaatttgtcctaacagcagtattgtcattttcatgtgacctgcagagcaggtttgtatcaatatttttttcctagagaaaagtcagcaactgacagacctctttattgatttttaggagctgcttcttgcagtgaaaggctttacagccactgggctgtgaacttattagagatggtcagaatgaatgcaccccatgagtcagacattggctttgtgtgaaagccagctttgaggggattagcttttgaaacaatgaacagcttgccttgaacttgattattgatctattgactgtcattaacaacaacttaaacattgtcttctgtgaaaattttccttgaagagtcctgttctatgtctttgccctttgacctttaacttgcaaactggcacaaactgaaggaaatctggtgttgcttctccattggattagttgttctctaaaacctagtaagcatgagctgtttccttagagtggagagagtggtgatggcagatctgcagatggacactttgctctttacatgcacactctgaaaatgccctataggtagaagtgaattttaatttcattttaatataatttcaagtctaaattcatcattttagtacaaattacaaaaactataggaaaaaaaaaacctcaaatacttgaatggccagtgtggcttttatataaagcaggaattttatactagtaaaaatttcttactcatttgctaatacacatttccagatgatttttaatgagtgtaggtatacattcttatttggaaatggatagtttggctgccttgaatttatatttatactcaacgtagcatgaaaattagaatgccttttggttaaactacatgtttatgatttggttggggaaaatattttataattgtgggtggcatgctgcaaagccttgcagattgttatttcttacaacctgagcgtatatagtatgagcctaagaaaaaagaagagtaagaaaagaagaatggctttacagtaaaatatcatacaatgcagacaatattttaagaggatattggagattatgtacgcaagggccaagaaagcaagaaatgagaaccagagtcagccctgtagctttacttcagtgcttccattctagatgatgctgatattataaagagttagtcactgctgctaagcatggaggactatatacataagctcgtttatacagtgtttgcttgtgggagggtttaatccttttagggccttgatgtcaagaaaaaaataactggaaactatattttgctaaagatagaaatgaggaactgtgtcattttgggacatgtgcaaatcattgaggaactccatcaccctgcattgaaaattgatttttttttcctctaaaatgagaaagaaactgaataagcaatctgttgcctctttactcattcatcacaatatcctgattcgtcataaggctatcagtatataagggctagaaaataatcatagcattaagaaggaaggagtctatcattatgcttgaattctggcaaatgtcatgaataagggttgggtcatatttactttaatatgagacaagatttatgtgataagcaaaggcatataaggctgctcttttgaacagaacatttcagttatcaggctgtactattacaagagataagaagacaataaggacaatgtaatcacaaacagtgggattccatttgtttattgtacaccagctactttgtgggtatggttcctgactcctcttctacatgaggtttgggaaaaaagtctcaaaccaaatggaacagtgaaagggaaagtaattcatctagcacataagaatagtgattcaaaaccaatgcagaataaatttccatgggtcaataacataaggtgtcagttcagtgttactagagatatgcaaggcataaaatattttcatcaccccatcactaataacatgaaaagctcagacataggatttcccaaattgaaatgaaaacacattcatgcctgcaaaaataattctccttctgcttcatttctcattactttatctaatataaacacaaatgtaaacaaggtaatggtcttcatgtaaaatgaccatatagttaagaattttagtaaaatattgttgttctgtgtattattaaacaaatgcaatgaagtattaaaatagctgatcagtttgaatttcctgtaaagcagtaattccgcatcagaattgtagataaggttgtgaatttattgactcatttcagaacagtgtctgttgacatggcagtcagagcaggtgaatacagatgctctttctgattgcaaaggttatagagctaaattagacagcattatgtgatactagcaaagacaacttctgttataaatcagagggcaaggcttttctgaatcgatgtgataaattactaagtaatgattaccaaaaataattactaagtaataaaagatacagactggtttactgaaataagcaagtgttacatttaataattacctataatctttttttgttaacacataagcaagtgttacctttaataattacctataatctttttttgttaacacataatttggccatttcatatactgtgtacctattttcattccctctctgtgggtcattaaaaaacacaatgtggtggataaaaaaaaaaaaaa

SEQ ID NO: 140 - protein, 607 aa, Homo sapiens
  MMP-16 precursor
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCKRSMQEWV

SEQ ID NO: 141 - protein, 481 aa, Homo sapiens
  MMP-16 mature
YALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCK

SEQ ID NO: 142 - DNA, 2438 bp, Homo sapiens
  MMP-17
ccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggttgccgctgctgccgctgccgctgctgctgctgctggcgctggggacccgcgggggctgcgccgcgcccgcacccgcgccgcgcgccgaggacctcagcctgggagtggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcaccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccgcggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcacggcccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttgtaaaaaaaaaaaaaaaaaaa

SEQ ID NO: 143 - protein, 606 aa, Homo sapiens
  MMP-17 precursor
MRRRAARGPGPPPPGPGLSRLPLLPLPLLLLLALGTRGGCAAPAPAPRAEDLSLGVEWLSRFGYLPPADPTTGQLQTQEELSKAITAMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSTADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 144 - protein, 478 aa, Homo sapiens
  MMP-17mature
QAPAPTKWNKRNLSWRVRTFPRDSPLGHDTVRALMYYALKVWSDIAPLNFHEVAGSTADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 145 - DNA, 3262 bp, Homo sapiens
  MMP-19
ggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccaggaacagaccctgcgcaggagagtcagagggggaagagttagaatgggtcagtggctggaacaaagttctggttaaggaggaaattagtgccacccacggtgagaagcagagaaggcacttgcatcctatgcagccctgaagaccaggctcctttgggcaaaaggcaagactctggcaggtgggtcaatgctctctccttggagcaagaagccagcttttggggaaggcaggtcctgaggcaggcactgccctgtggtcttccccaggttgaggagagaagtggaagccccatggaagacagtgctcccagctgaggtaggaggcggaggtgggggtgggggtagtttaagcctatggggcccagggggaaaggccaaacagaaacccaactaccccctaatgaagggcctggaggttggggtatcttggagctcctcagagcccttcttcccatcaaaaaggtatcaaatgccttggaagctccctgatcctacaaaacaaaaaaatgcttatttttaccactgtgaggcaagctgaggtgaacatttaaaaggctatttcaagacgaggtgcggtggctataatcctagcactttgggaggctgaagcaggaggatcacttgagcccaggagttcaagaccagcttgggcaacatagggagaccctgtctctgcaaaaaaataaaaacgaatacataaaaattaaaaaaaaa

SEQ ID NO: 146 - protein, 508 aa, Homo sapiens
  MMP-19 precursor
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 147 - protein, 411 aa, Homo sapiens
  MMP-19 mature
YLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 148 - DNA, 1674 bp, Homo sapiens
  MMP-20
ctactgtgaggggatgaaggtgctccctgcatctggccttgctgtcttcctcatcatggctttgaagttttccactgcagccccctccctagttgcagcctcccccaggacctggaggaacaactaccgcctcgcacaggcgtatcttgacaaatattacacaaataaagaaggacaccagattggtgagatggttgcaagaggaagcaattccatgataaggaagattaaggagctacaagcgttctttggcctccaagtcaccgggaagttagaccagaccacaatgaacgtgatcaagaagcctcgctgtggagttcctgatgtggccaattatcgcctcttccctggtgaacccaaatggaaaaaaaatactttgacatacagaatatctaaatacacaccttccatgagttctgtcgaggtggacaaagcagtggagatggccttgcaggcctggagtagcgccgtccctctgagctttgtcagaataaactcaggagaagcggatattatgatatcttttgaaaatggagatcacggggattcctatccattcgatgggcctcgggggactctagcccatgcatttgctcctggagaaggcctgggaggagatacacatttcgacaatcctgagaagtggactatgggaacgaatggttttaatttgtttaccgttgctgctcatgaatttggccatgccctgggcctggcccattccacagacccatcagcactgatgtacccaacttataagtacaagaatccctatggattccacctccccaaagatgatgtgaaagggatccaggcattatacggacctcggaaagtattcctggggaagcccactctgccccatgccccccatcacaagccatccatccctgacctctgtgactccagctcatcctttgacgctgtgacaatgctggggaaggagctcctgctcttcaaggaccggattttctggagacggcaggttcacttgcggacaggaattcggcccagcactattaccagctccttcccccagctcatgtccaatgtggatgcagcttacgaagtggctgagaggggcactgcttacttcttcaaaggtccccactactggataacaagaggattccaaatgcaaggtcctcctcggactatttatgactttggatttccaaggcacgtgcagcaaatagatgctgctgtctacctcagggagccacagaagacccttttctttgtgggagatgaatactacagctacgacgaaaggaaaaggaaaatggaaaaagactatccaaagaatactgaagaagaattttcaggagtaaatggccaaatcgatgctgctgtagaattaaatggctacatttacttcttttcaggaccaaaaacatacaagtatgacacagagaaggaagatgtggttagtgtggtgaaatctagttcctggattggttgctaaatagaaaagcctagtcttctcaagcaatgaggatgactacaagcagcctctaactggatcttaaggactaaagcagaatgtaggagagggattcttccaaaggccttcaaatcaaattagaattcactgagaataataatacttccaatttttttcatagttgtataatcagaatttcaatccacattagaaaagtttttatatgggca

SEQ ID NO: 149 - protein, 483 aa, Homo sapiens [sequence omitted]

SEQ ID NO: 150 - protein, 373 aa, Homo sapiens
  MMP-20 mature
YRLFPGEPKWKKNTLTYRISKYTPSMSSVEVDKAVEMALQAWSSAVPLSFVRINSGEADIMISFENGDHGDSYPFDGPRGTLAHAFAPGEGLGGDTHFDNAEKWTMGTNGFNLFTVAAHEFGHALGLAHSTDPSALMYPTYKYKNPYGFHLPKDDVKGIQALYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSW

SEQ ID NO: 151 - DNA, 3127 bp, Xenopus laevis
  XMMP
tcgtggagcactacagaatatgccgcacagagtcagcagaacggcagcagatgcatcagcatcatatgaggccaccatgccttctatcaagcttctggtttggtgctgcttgtgtgtgatatcccccaggctgtgccattctgagaagctcttccacagtcgggatcggtcagaccttcagccctcagcaattgaacaggcagaactggtcaaggatatgctctctgcccagcaattcctggcaaaatatgggtggacacaaccagttatttgggatccatcaagtaccaatgaaaacgaacctctaaaagatttcagtctgatgcaagagggagtttgtaacccaaggcaagaagtggctgagccaacaaaaagcccccaattcattgacgcgctcaaaaagtttcagaagctaaacaacttgccagtgacaggaacccttgatgatgccaccatcaacgccatgaacaagccacggtgcggcgtgccagacaaccaaatggcaaagaaagagacggagaaaccgacagcagcacagtcacttgaaaacaagactaaggattctgagaatgttactcaacaaaacccagacccccccaagattcggaggaagaggttcttagatatgttaatgtactcaaacaagtacagggaagaacaggaggcgcttcagaaatccacaggcaaagtcttcaccaaaaagctgctgaaatggagaatgattggagaaggctacagcaatcagctttccatcaacgagcaaagatatgtcttcaggctggctttccgcatgtggagtgaagtcatgccactggactttgaagaagataacacctcccctctatcccaaattgatatcaaacttggattcggacgaggtcgccatttaggctgtagccgggcattcgatggctctgggcaggagttcgcccacgcttggtttctgggggacattcactttgacgacgatgaacattttactgctcccagtagtgagcatgggattagtctgctgaaggtggcagcccatgaaattggccatgttcttggattatctcacatccacagggtgggatcaataatgcagcccaattacattccgcaggactctggctttgagctggacttgtctgacaggagagccatacagaacctatacggctcatgtgaaggcccctttgacacagcgtttgactggatctataaagagaagaaccaatacggggagcttgttgttcgatacaacacctacttttttcgcaacagctggtactggatgtatgagaatcggagcaacaggacccgatacggggatccacttgcaattgccaacggctggcacggaattcccgtacagaatattgatgcttttgttcatgtctggacctggacaagagacgcctcctacttttttaaaggtactcagtactggcgctacgatagtgaaaatgacaaagcctatgctgaagatgcacagggaaagagctaccctcgcctaatctcagaagggtttcctggaatcccaagccccatcaatgctgcctattttgacaggagaagacagtacatttacttcttcagggactcccaggtttttgcctttgatatcaacagaaacagagttgcgccagacttccccaaaagaatcttggactttttcccagccgtcgcagcaaacaatcaccccaagggcaacatagacgtggcctattattcctacacatacagctccttatttctcttcaaaggaaaagagttttggaaagtcgtcagcgacaaggacaggaggcaaaacccgtctcttccatacaatggattgttccccagaagagcaatatctcagcagtggtttgatatctgcaacgtacacccttcattgctgaaaatttgatttgcccaaaatagcccagcctgaataatagtcatgcactgaggttttctaaagtcttcttctgcccttgtcccacctgtgcactcacctgtagcatggacagcccaaaatagcccagcctgaataatagtcatccactgaggttttctaaagtcttcttctgcccttgtcccacctgtgcactcacctgtagcatggacatactcccagatgattgacctttctacaactctacttccagagtgtccatgtctaagaatttcttagtaaaagagttgactagactattgtattgtttcctaaacgcagccataaaggagctccaacagcacaagattccaggaagccattccctcaattcataaaggacaggagtgtgcgctccaataatggctaatatatgtacattattaaacacaagaatgggagaaatccattcgagaaaaaagtatttattagttgagatgaatcccaatttgggaagattgagagttgaacaaggatccttattatgtatctgcttaaatgttttatttatccatttttgcttgagtttctgcttcgattaggaagtattggagcatgattcataatgattgaactgatgtgaacttctccagaatgcacttctaaacacaaacataatactgatggaggaggaataattgtatggggatagaggctccatagaaggcaaactttaaggctgcaataatatcgtggtcaaatatgtgctttctcattggtggtaaaggtttattgaaggccctttgcttcttctgctcaacagtggaccatgtgctcaaagtaagctccctacacaatggttgatggaaatgtgactggtctgcatgaagccctcaacccaactgaacaactgtgggatgaattggaccatggattaagggagccaggccggatcattgaagccggacctcactcatgcttttgtggttgaagagcaaatcccaccactaatcttccaagacctagaggaaagcctttccagaagagcagaggctgttgcagcaaaggaatgtctaactctatatcaaaaccttcaggcttcagaattgcatgttctcattaataaatgtgtagcatcgggactctatagctcttaaaggccgtgcatgtttgatttagaaagatacacttgatgttattactgagctttatacagcactgttattctgcacaaataaaacttttactttacaaaaaaaaaaaaaaaaa

SEQ ID NO: 152 - protein, 604 aa, Xenopus laevis
  XMMP precursor
MPSIKLLVWCCLCVISPRLCHSEKLFHSRDRSDLQPSAIEQAELVKDMLSAQQFLAKYGWTQPVIWDPSSTNENEPLKDFSLMQEGVCNPRQEVAEPTKSPQFIDALKKFQKLNNLPVTGTLDDATINAMNKPRCGVPDNQMAKKETEKPTAAQSLENKTKDSENVTQQNPDPPKIRRKRFLDMLMYSNKYREEQEALQKSTGKVFTKKLLKWRMIGEGYSNQLSINEQRYVFRLAFRMWSEVMPLDFEEDNTSPLSQIDIKLGFGRGRHLGCSRAFDGSGQEFAHAWFLGDIHFDDDEHFTAPSSEHGISLLKVAAHEIGHVLGLSHIHRVGSIMQPNYIPQDSGFELDLSDRRAIQNLYGSCEGPFDTAFDWIYKEKNQYGELVVRYNTYFFRNSWYWMYENRSNRTRYGDPLAIANGWHGIPVQNIDAFVHVWTWTRDASYFFKGTQYWRYDSENDKAYAEDAQGKSYPRLISEGFPGIPSPINAAYFDRRRQYIYFFRDSQVFAFDINRNRVAPDFPKRILDFFPAVAANNHPKGNIDVAYYSYTYSSLFLFKGKEFWKVVSDKDRRQNPSLPYNGLFPRRAISQQWFDICNVHPSLLKI

SEQ ID NO: 153 - protein, 420 aa, Xenopus laevis
  XMMP mature
FLDMLMYSNKYREEQEALQKSTGKVFTKKLLKWRMIGEGYSNQLSINEQRYVFRLAFRMWSEVMPLDFEEDNTSPLSQIDIKLGFGRGRHLGCSRAFDGSGQEFAHAWFLGDIHFDDDEHFTAPSSEHGISLLKVAAHEIGHVLGLSHIHRVGSIMQPNYIPQDSGFELDLSDRRAIQNLYGSCEGPFDTAFDWIYKEKNQYGELVVRYNTYFFRNSWYWMYENRSNRTRYGDPLAIANGWHGIPVQNIDAFVHVWTWTRDASYFFKGTQYWRYDSENDKAYAEDAQGKSYPRLISEGFPGIPSPINAAYFDRRRQYIYFFRDSQVFAFDINRNRVAPDFPKRILDFFPAVAANNHPKGNIDVAYYSYTYSSLFLFKGKEFWKVVSDKDRRQNPSLPYNGLFPRRAISQQWFDICNVHPS

SEQ ID NO: 154 - DNA, 1694 bp, Homo sapiens
  heparanase
gggcaccagccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccagggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaaaaaaaaaaaaaaaaaaaaa

SEQ ID NO: 155 - protein, 543 aa, Homo sapiens
  heparanase precursor
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATREDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 156 - protein, 460 aa, Homo sapiens
  heparanase mature
  heparanase 8 kDa subunit
  heparanase 50 kDa subunit
QDVVDLDFFTQEPLHLVSPSFLSVTIDANLATDPRFLILLGSPKLRTLARGLSPAYLRFGGTKTDFLIFDPKKEKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATREDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 157 - DNA, 4670 bp, Homo sapiens
  ADAMTS-1
gcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaaaaaaaaaaaaaaaaaaaaa

SEQ ID NO: 158 - protein, 967 aa, Homo sapiens
  ADAMTS- precursor
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 159 - protein, 715 aa, Homo sapiens
  ADAMTS-1 mature
FVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 160 - DNA, 3636 bp, Homo sapiens
  ADAMTS-2
atggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgatgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgatgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgccctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtcctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 161 - protein, 1211 aa, Homo sapiens
  ADAMTS-2 precursor
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVPCRTADDSFGICQEERPETARTCRLGPCPRNISDPSKKSYVVQWLSRPDPDSPIRKISSKGHCQGDKSIFCRMEVLSRYCSIPGYNKLSCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 162 - protein, 958 aa, Homo sapiens
  ADAMTS-2 mature
RRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVPCRTADDSFGICQEERPETARTCRLGPCPRNISDPSKKSYVVQWLSRPDPDSPIRKISSKGHCQGDKSIFCRMEVLSRYCSIPGYNKLSCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 163 - DNA, 5821 bp, Homo sapiens
  ADAMTS-3
gctttgcccagtagttggaaagtgaactcgactcgtgatggttctcctgtcactttggttgatagcagccgctctggtagaggttaggacttcagctgatggacaagctggtaatgaagaaatggtgcaaatagatttaccaataaagagatatagagagtatgagctggtgactccagtcagcacaaatctagaaggacgctatctctcccatactctttctgcgagtcacaaaaagaggtcagcgagggacgtgtcttccaaccctgagcagttgttctttaacatcacggcatttggaaaagattttcatctgcgactaaagcccaacactcaactagtagctcctggggctgttgtggagtggcatgagacatctctggtgcctgggaatataaccgatcccattaacaaccatcaaccaggaagtgctacgtatagaatccggaaaacagagcctttgcagactaactgtgcttatgttggtgacatcgtggacattccaggaacctctgttgccatcagcaactgtgatggtctggctggaatgataaaaagtgataatgaagagtatttcattgaacccttggaaagaggtaaacagatggaggaagaaaaaggaaggattcatgttgtctacaagagatcagctgtagaacaggctcccatagacatgtccaaagacttccactacagagagtcggacctggaaggccttgatgatctaggtactgtttatggcaacatccaccagcagctgaatgaaacaatgagacgccgcagacacgcgggagaaaacgattacaatatcgaggtactgctgggagtggatgactctgtggtccgtttccatggcaaagagcacgtccaaaactacctcctgaccctaatgaacattgtgaatgaaatttaccatgatgagtccctcggagtgcatataaatgtggtcctggtgcgcatgataatgctgggatatgcaaagtccatcagcctcatagaaaggggaaacccatccagaagcttggagaatgtgtgtcgctgggcgtcccaacagcaaagatctgatctcaaccactctgaacaccatgaccatgcaatttttttaaccaggcaagactttggacctgctggaatgcaaggatatgctccagtcaccggcatgtgtcatccagtgagaagttgtaccctgaatcatgaggatggtttttcatctgcttttgtagtagcccatgaaacgggccatgtgttgggaatggagcatgatggacaaggcaacaggtgtggtgatgagactgctatgggaagtgtcatggctcccttggtacaagcagcattccatcgttaccactggtcccgatgcagtggtcaagaactgaaaagatatatccattcctatgactgtctccttgatgacccttttgatcatgattggcctaaactcccagaacttcctggaatcaattattctatggatgagcaatgtcgttttgattttggtgttggctataaaatgtgcaccgcgttccgaacctttgacccatgtaaacagctgtggtgtagccatcctgataatccctacttttgtaagactaaaaagggacctccacttgatgggactgaatgtgctgctggaaaatggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgcccatcaatggtggtcaggattgtcctggtgttaattttgagtaccagctttgtaacacagaagaatgccaaaaacactttgaggacttcagagcacagcagtgtcagcagcgaaactcccactttgaataccagaataccaaacaccactggttgccatatgaacatcctgaccccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggtaccttaagatgtttgatataccccctggggctagacatgtgttaatccaagaagacgaggcttctcctcatattcttgctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgttttgattatacctcaagaaaatgatacccgctctagcctgacatataagtacatcatccatgaagactctgtacctacaatcaacagcaacaatgtcatccaggaagaattagatacttttgagtgggctttgaagagctggtctcagtgttccaaaccctgtggtggaggtttccagtacactaaatatggatgccgtaggaaaagtgataataaaatggtccatcgcagcttctgtgaggccaacaaaaagccgaaacctattagacgaatgtgcaatattcaagagtgtacacatccactctgggtagcagaagaatgggaacactgcaccaaaacctgtggaagttctggctatcagcttcgcactgtacgctgccttcagccactccttgatggcaccaaccgctctgtgcacagcaaatactgcatgggtgaccgtcccgagagccgccggccctgtaacagagtgccctgccctgcacagtggaaaacaggaccctggagtgagtgttcagtgacctgcggtgaaggaacggaggtgaggcaggtcctctgcagggctggggaccactgtgatggtgaaaagcctgagtcggtcagagcctgtcaactgcctccttgtaatgatgaaccatgtttgggagacaagtccatattctgtcaaatggaagtgttggcacgatactgctccataccaggttataacaagttatgttgtgagtcctgcagcaagcgcagtagcaccctgccaccaccataccttctagaagctgctgaaactcatgatgatgtcatctctaaccctagtgacctccctagatctctagtgatgcctacatctttggttccttatcattcagagacccctgcaaagaagatgtctttgagtagcatctcttcagtgggaggtccaaatgcatatgctgctttcaggccaaacagtaaacctgatggtgctaatttacgccagaggagtgctcagcaagcaggaagtaagactgtgagactggtcaccgtaccatcctccccacccaccaagagggtccacctcagttcagcttcacaaatggctgctgcttccttctttgcagccagtgattcaataggtgcttcttctcaggcaagaacctcaaagaaagatggaaagatcattgacaacagacgtccgacaagatcatccaccttagaaagatgagaaagtgaaccaaaaaggctagaaaccagaggaaaacctggacaacctctctcttcccatggtgcatatgcttgtttaaagtggaaatctctatagatcgtcagctcattttatctgtaattggaagaacagaaagtgctggctcactttctagttgctttcatcctccttttgttctgcattgactcatttaccagaattcattggaagaaatcaccaaagattattacaaaagaaaaatatgttgctaagattgtgttggtcgctctctgaagcagaaaagggactggaaccaattgtgcatatcagctgactttttgtttgttttagaaaagttacagtaaaaattaaaaagagataccaatggtttacactttaacaagaaattttggatatggaacaaagaattcttagacttgtattcctatttatctatattagaaatattgtatgagcaaatttgcagctgttgtgtaaatactgtatattgcaaaaatcagtattattttaagagatgtgttctcaaatgattgtttactatattacatttctggatgttctaggtgcctgtcgttgagtattgccttgtttgacattctataggttaattttcaaagcagagtattacaaaagagaagttagaattacagctactgacaatataaagggttttgttgaatcaacaatgtgatacgtaaattatagaaaaagaaaagaaacacaaaagctatagatatacagatatcagcttacctattgccttctatacttataatttaaaggattggtgtcttagtacacttgtggtcacagggatcaacgaatagtaaataatgaactcgtgcaagacaaaactgaaaccctctttccaggacctcagtaggcaccgttgaggtgtcctttgtttttgtgtgtgtgtgttcttttttaattttcgcattgttgacagatacaaacagttatactcaatgtactgtaataatcgcaaaggaaaaagttttgggataacttatttgtatgttggtagctgagaaaaatatcatcagtctagaattgatatttgagtatagtagagctttggggctttgaaggcaggttcaagaaagcatatgtcgatggttgagatatttattttccatatggttcatgttcaaatgttcacaaccacaatgcatctgactgcaataatgtgctaataatttatgtcagtagtcaccttgctcacagcaaagccagaaatgctctctccagggagtagatgtaaagtacttgtacatagaattcagaactgaagatatttattaaaagttgattttttttcttgatagtatttttatgtactaaatatttacactaatatcaattacatattttggtaaactagagagacataattagagatgcatgctttgttctgtgcatagagacctttaagcaaactactacagccaactcaaaagctaaaactgaacaaatttgatgttatgcaaacatcttgcatttttagtagttgatattaagttgatgacttgtttcccttcaaggaaacattaaattgtatggactcagctagctgttcaatgaaattgtgaattagaaacatttttaaaagtttttgaaagagataagtgcatcatgaattacatgtacatgagaggagatagtgatatcagcataatgattttgaggtcagtacctgagctgtctaaaaatatattatacaaactaaaatgtagatgaattaacctctcaaagcacagaatgtgcaagaacttttgcattttaatcgttgtaaactaacagcttaaactattgactctatacctctaaagaattgctgctactttgtgcaagaactttgaaggtcaaattaggcaaattccagatagtaaaacaatccctaagccttaagtcttttttttttcctaaaaattcccatagaataaaattctctctagtttacttgtgtgtgcatacatctcatccacaggggaagataaagatggtcacacaaacagtttccataaagatgtacatattcattatacttctgacctttgggctttcttttctactaagctaaaaattcctttttatcaaagtgtacactactgatgctgtttgttgtactgagagcacgtaccaataaaaatgttaacaaaatat

SEQ ID NO: 164 - protein, 1205 aa, Homo sapiens
  ADAMTS-3 precursor
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRKTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQVSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 165 - DNA, 4342 bp, Homo sapiens
  ADAMTS-4
gggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccggctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactcaaaaaaaaaaaa

SEQ ID NO: 166 - DNA, 4342 bp, Homo sapiens; identical to SEQ ID NO: 165
  ADAMTS-4

SEQ ID NO: 167 - protein, 837 aa, Homo sapiens
  ADAMTS-4  precursor
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQARALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 168 - protein, 625 aa, Homo sapiens
  ADAMTS-4  mature
FASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQARALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 169 - DNA, 9046 bp, Homo sapiens
  ADAMTS-5
cttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacgctagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggatttatgtgggcatcattcatgtgacaccctgggaatggcagacgttgggaccatatgttctccagagcgcagctgtgctgtgattgaagacgatggcctccacgcagccttcactgtggctcacgaaatcggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcaacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccgctcctgcagtctcatgccctgcccacccaatggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtgaccgatggcactgaatgtaggccgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaagtaagggttacactgacgtggtgaggattcctgaaggggcaacccacataaaagttcgacagttcaaagccaaagaccagactagattcactgcctatttagccctgaaaaagaaaaacggtgagtaccttatcaatggaaagtacatgatctccacttcagagactatcattgacatcaatggaacagtcatgaactatagcggttggagccacagggatgacttcctgcatggcatgggctactctgccacgaaggaaattctaatagtgcagattcttgcaacagaccccactaaaccattagatgtccgttatagcttttttgttcccaagaagtccactccaaaagtaaactctgtcactagtcatggcagcaataaagtgggatcacacacttcgcagccgcagtgggtcacgggcccatggctcgcctgctctaggacctgtgacacaggttggcacaccagaacggtgcagtgccaggatggaaaccggaagttagcaaaaggatgtcctctctcccaaaggccttctgcgtttaagcaatgcttgttgaagaaatgttagcctgtggttatgatcttatgcacaaagataactggaggattcagcactgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatacattctcccttggtatgtcactttatatcccctggttctattaaaatatccatatatatttctataaaaaaagtgtttgaccaaagtaggtctgcagctatttcaacttccttccgtttccagaaagagctgtggatattttactggaaattaagaacttgctgctgttttaataagatgtagtatattttctgactacaggagataaaatttcagtcaaaaaaccattttgacagcaagtatcttctgagaaattttgaaaagtaaatagatctcagtgtatctagtcacttaaatacatacacgggttcatttacttaaacctttgactgcctgtatttttttcaggtagctagccaaattaatgcataatttcagatgtagaagtagggtttgcgtgtgtgtgtgtgatcatactcaagagtctaaaaactagtttccttgtgttggaaatttaaaaggaaaaaaatcgtatttcactgtgttttcaatttatattttcacaactactttctctctccagagctttcatctgatatctcacaatgtatgatatacgtacaaaacacacagcaagttttctatcatgtccaacacattcaacactggtatacctcctaccagcaagcctttaaaatgcatttgtgtttgcttatttgttttgttcaagggttcagtaagacctacaatgttttgtatttcttgacttattttattagaaacattaaagatcacttggtagttagccacattgagaagtggttatcattgttaatgtggttaatgccaaaaagtggttaatattaataagactgtttccacaccataggcaataatttcttaatttaaaaaatctaagtatattcctattgtactaaatatttttcccaactggaaagcacttgattgtacccgtaagtgtttgagtgatgacatgtgatgattttcagaaagttgttgtttttgtttccatagcctgtttaagtaggttgtaagtttgaatagttagacatggaaattattttataagcacacacctaaagatatctttttagatgataaaatgtacacccccccatcaccaacctcacaacttagaaaatctaagttgtttgatttctttgggatttcttttgttgtgaaacactgcaaagccaatttttctttataaaaattcatagtaatcctgccaaatgtgcctattgttaaagatttgcatgtgaagatcttagggaaccactgtttgagttctacaagctcatgagagtttatttttattataagatgtttttaatataaaagaattatgtaactgatcactatattacatcatttcagtgggccaggaaaatagatgtcttgctgttttcagtattttcttaagaaattgcttttaaaacaaataattgttttacaaaaccaataattatcctttgaattttcatagactgactttgcttttgacgtagaaattttttttctcaataaattatcactttgagaaatgaggcctgtacaaggctgataacctatatgtgatggagatcacccaatgccaagggcagaaagcaaacctagttaaataggtgagaaaaaaaataataatcccagtgccatttgtctgtgcaaagagaattaggagagaggttaatgttacttttttccattttggaaataattttaatcaagtaactcaaatgtgacaaaatttatttttattttttgtggttatattcccaacaacattaaaaaatactcgaggcataaatgtagttgtctcctactctgcttctcttactatactcatacatttttaatatggtttatcaatgattcatgtttccctcaaatagtgatggtttacacctgtcatggaaacaatcctagagagctcagagcaattaaaccactattccatgcttttaagtagttttctccacctttttcttatgagtctcactagattgactgaggaatgtatgtctaaattcctggagaagatgatatggattggaaactgaaattcagagaaatggagtgttcaatagataccacgaattgtgaacaaagggaaaattctatacaactcaatctaagtcagtccactttgacttcgtactgtctttcacctttccattgttgcatcttgaattttttaaaatgtctagaattcaggatgctaggggctacttctttaaaaaaaaaaaaaaaaaagaattcgtctgaaaatgctcaggtttgtaagaatctaatctcacttacataactaagcactccataataagttttattaagtacaaagggagccagaaaaaatgacatttatttcttctagatcagaaaaatttaaattaagccctgccttgctgtttagaaatatgtgggcattgttataatttattcaataaatttatgttcctttgccttcctgtggaaacagttttatcccactaaactaggaattaggggataaatcacaaacaaaaaaaaagttgcagcactgaaaaaaagtaatttattgtttttgcaactggtatgtgaatttgtgtgataaaattatttattcttatttaacaaaaatatgttcaaatttttctatatttaaaatgttttgctgttgtcctactttttaatttatgcttcatgtttgtgtataaagtacacttttacactttgtgagtttacataatatacagcactggttgcttttgtatttttttacagaaagctttctgtgtgaagcaggtgtatatgtatatattcctcatgtattcttattctgatactatcatttttctttccaaggaaattttaatctgtcatgaccaatagtgttcattacttgtgcctatgataataggttttttacatcacattaacactattttttccaagtcacaaataagaaaaacacttattcaatgaaacaaggtgcaagttttaaatttgggtacacaaatagcctagaagcttcctacagacgctaagacacagccaataatcagatcctttcacttcatcgagaaacttggacaagtcgatattgatgtattagatgaaagttgtctacacacaacttctgagggatacaaacgataataaaaccaaatgttgtctgtttctcctttagaaacacctcctaaaattaatatcatttagtctctagtgtctgtaggattctacagatgagcacaaatagattgggtttgtataacaaatgctaatagtcataactgtttctacaaatatggggtgtccattaagagaatgtgatgttttcctactgctgttgaatcccatggggtgattataggacttgaaataggcagagtcacctctgatgacatcagcttgcctctgtgatttcacagtctgatcctggcaacaagacaaagcacccttggacacacagccaatctctggttgtgatatttccccattgattccttccttgttaacaaggtcattttaatggttcaggtgaggacagcagccagattcaaagtccagaatttgtgctgttacatagagttcacactgtcaaataacattgaatttaataatgatcaaatttttctagtagtctttggcagagtgtataatctcattggcatgattggtgaatattactaatctctttataatgaaagatgctttacaaataccttatatttgctaacatttcaaaactactaaataaatgaaatagccatgtgtacagaaatggtcatttaaagctttaatagaaccaaattcaagacaatgtatcatttagacacacagaaaaggaacttgtatgttttccctattatttttctcatttgccaacaatctatagttttaggttatcaaacagatagatcaacttaactggctagtacattgaaaaatcttcctaagaatcctttgttagcataatctatagagataatttctcaaattatatcatcatgatgcatataaactctataatgtataattgtgtttcatttatttaatgtatgagaacatattgaaatacaaaaccatgcattagccaaaaaattggaatacaggtagtgttcagatcagcaaaacattcagtctggtaaatgcctgcctggggctatgatatcattctcaatgcaggttttatggaaaaactaaaagaatatgttgttagatgatgttggttttgaaaaaaaaaagacattaacatacacattagttagcccagttaattgcattctactaatatagttgcacattagcaataattttgctgtctctggtctttattttgtggcttcaactaactggaccatgtggactgtaaaggtcaaatggaaaaaacgagcagtggcccctcatcctgtaaggtactgctacatcagagtgacctaaaagtctaacactgtgaggaaaactgtgatttgtaggaaaaaaaaaaaaaacaaataaaaaacagggcatgctttttaatttttttccactttcctttggcacacccaatgaacaattctaatttttattgaggtgctaacatctttcgtgaccgactgtcaaatgtggtatttttgagttactatttttctacatgattttacagtttgcaagaaagacctctaagctttgtgtcacggtagggcacaacttgatactcaaaatttgaaaaataagcacatccaatgattgttttgaccaacagtggtcagtgacgtaaactgcatgtgcatctgaggacatttaaggggtcattaaaatttgaggagcatcaggccggagtagcagacttttagatgagtcatatttcagcattcactaagtcctcagcattccattcaaactgtcgtgtatatttggcctgattttttttcaagctttgcaataatttatgttattggtaaacacttggtgactatatctcagccttttctttaacaactcacaatatattagaaacacgtctacctatactgagagtatatttacaatagaagaacatactgtatgtgactttgtaaagctagacttttgattaagaaatatataatctctggatgctatttttgcattatacactcaggcacaacgtaaaccttgatggctcatcttgctacaattacgagttgaaaaacactacttacgtatttgtatgacctattagtcagaggaaatcatacatatgctttgtaaatagactttgcagataactaaatagactgaagaaatatgttgcatttgatagaagcaattgcataaatatttggtttctatattagagtctgtgagtaaagtcaagtaataaacctaagtaggtataacagatttttaaaccttgaaacttgctttgatggtagagaaaatcattgaagatttacatactgtatataagatgtaaaatgtacgctgcttattaccctcaattttccagaagcaatggtatataatgcagttgaaaaaccaaaaatcttggaaaactaagacgggtcttgtttaaaatgtctctcagctttggcaaccttcaaatcttaatcaactatttaaagcattactgtgtcttgtagcctgcattccacaacagctctgttattcaggtaaaagacttgaactgagccgtttgggacctatactgtaatattttcattgaggaacaatatcctattttgtaaagcatttccctatgtgtgactttaaactgtaaaattaaacactgcttttgtgggttcagtgggcataataaatataaattgtaaacta

SEQ ID NO: 170 - protein, 930 aa, Homo sapiens
  ADAMTS-5  precursor
MLLGWASLLLCAFRLPLAAVGPAATPAQDKAGQPPTAAAAAQPRRRQGEEVQERAEPPGHPHPLAQRRRSKGLVQNIDQLYSGGGKVGYLVYAGGRRFLLDLERDGSVGIAGFVPAGGGTSAPWRHRSHCFYRGTVDASPRSLAVFDLCGGLDGFFAVKHARYTLKPLLRGPWAEEEKGRVYGDGSARILHVYTREGFSFEALPPRASCETPASTPEAHEHAPAHSNPSGRAALASQLLDQSALSPAGGSGPQTWWRRRRRSISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYRSCSLMPCPPNGKSFRHEQCEAKNGYQSDAKGVKTFVEWVPKYAGVLPADVCKLTCRAKGTGYYVVFSPKVTDGTECRPYSNSVCVRGKCVRTGCDGIIGSKLQYDKCGVCGGDNSSCTKIVGTFNKKSKGYTDVVRIPEGATHIKVRQFKAKDQTRFTAYLALKKKNGEYLINGKYMISTSETIIDINGTVMNYSGWSHRDDFLHGMGYSATKEILIVQILATDPTKPLDVRYSFFVPKKSTPKVNSVTSHGSNKVGSHTSQPQWVTGPWLACSRTCDTGWHTRTVQCQDGNRKLAKGCPLSQRPSAFKQCLLKKC

SEQ ID NO: 171 - protein, 669 aa, Homo sapiens
  ADAMTS-5  mature
SISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYRSCSLMPCPPNGKSFRHEQCEAKNGYQSDAKGVKTFVEWVPKYAGVLPADVCKLTCRAKGTGYYVVFSPKVTDGTECRPYSNSVCVRGKCVRTGCDGIIGSKLQYDKCGVCGGDNSSCTKIVGTFNKKSKGYTDVVRIPEGATHIKVRQFKAKDQTRFTAYLALKKKNGEYLINGKYMISTSETIIDINGTVMNYSGWSHRDDFLHGMGYSATKEILIVQILATDPTKPLDVRYSFFVPKKSTPKVNSVTSHGSNKVGSHTSQPQWVTGPWLACSRTCDTGWHTRTVQCQDGNRKLAKGCPLSQRPSAFKQCLLKKC

SEQ ID NO: 172 - DNA, 5269 bp, Homo sapiens
  unsure (0)...(0): ADAMTS14  transcript variant 1
atggctccactccgcgcgctgctgtcctacctgctgcctttgcactgtgcgctctgcgccgccgcgggcagccggaccccagagctgcacctctctggaaagctcagtgactatggtgtgacagtgccctgcagcacagactttcggggacgcttcctctcccacgtggtgtctggcccagcagcagcctctgcagggagcatggtagtggacacgccacccacactaccacgacactccagtcacctccgggtggctcgcagccctctgcacccaggagggaccctgtggcctggcagggtggggcgccactccctctacttcaatgtcactgttttcgggaaggaactgcacttgcgcctgcggcccaatcggaggttggtagtgccaggatcctcagtggagtggcaggaggattttcgggagctgttccggcagcccttacggcaggagtgtgtgtacactggaggtgtcactggaatgcctggggcagctgttgccatcagcaactgtgacggattggcgggcctcatccgcacagacagcaccgacttcttcattgagcctctggagcggggccagcaggagaaggaggccagcgggaggacacatgtggtgtaccgccgggaggccgtccagcaggagtgggcagaacctgacggggacctgcacaatgaagcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcaggtatgcaagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcattcaggacctttgagccctgcaagcagctgtggtgcagccatcctgacaacccgtacttctgcaagaccaagaaggggcccccgctggatgggactgagtgtgcacccggcaagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcaggagctctcaagctggtgcagatcccagcaggtgccaggcacatccagattgaggcactggagaagtccccccaccgcattgtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgcgccggggaccggcctgaggcccgacggccctgtctccgagtgccctgcccagcccagtggaggctgggagcctggtcccagtgctctgccacctgtggagagggcatccagcagcggcaggtggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccccccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccggtgacatgagctgtgccctgccatcccactggcacgtttacactctgtgtactgccccgtgactcccagctcagaggacacacatagcagggcaggcgcaagcacagacttcattttaaatcattcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcactccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgcggagtcattcctgtgagaaccagcctggcctgtgttaaactcttgtgccttggaaatccagatctttaaaattttatgtatttattaacatcgccattggaccccaaaa

SEQ ID NO: 173 - protein, 1226 aa, Homo sapiens
  ADAMTS14 isoform 1 precursor
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGMQGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 174 - protein, 974 aa, Homo sapiens
  ADAMTS14 isoform 1 mature
HAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGMQGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 175 - DNA, 5260 bp, Homo sapiens
  ADAMTS14  transcript variant 2
atggctccactccgcgcgctgctgtcctacctgctgcctttgcactgtgcgctctgcgccgccgcgggcagccggaccccagagctgcacctctctggaaagctcagtgactatggtgtgacagtgccctgcagcacagactttcggggacgcttcctctcccacgtggtgtctggcccagcagcagcctctgcagggagcatggtagtggacacgccacccacactaccacgacactccagtcacctccgggtggctcgcagccctctgcacccaggagggaccctgtggcctggcagggtggggcgccactccctctacttcaatgtcactgttttcgggaaggaactgcacttgcgcctgcggcccaatcggaggttggtagtgccaggatcctcagtggagtggcaggaggattttcgggagctgttccggcagcccttacggcaggagtgtgtgtacactggaggtgtcactggaatgcctggggcagctgttgccatcagcaactgtgacggattggcgggcctcatccgcacagacagcaccgacttcttcattgagcctctggagcggggccagcaggagaaggaggccagcgggaggacacatgtggtgtaccgccgggaggccgtccagcaggagtgggcagaacctgacggggacctgcacaatgaagcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcattcaggacctttgagccctgcaagcagctgtggtgcagccatcctgacaacccgtacttctgcaagaccaagaaggggcccccgctggatgggactgagtgtgcacccggcaagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcaggagctctcaagctggtgcagatcccagcaggtgccaggcacatccagattgaggcactggagaagtccccccaccgcattgtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgcgccggggaccggcctgaggcccgacggccctgtctccgagtgccctgcccagcccagtggaggctgggagcctggtcccagtgctctgccacctgtggagagggcatccagcagcggcaggtggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccccccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccggtgacatgagctgtgccctgccatcccactggcacgtttacactctgtgtactgccccgtgactcccagctcagaggacacacatagcagggcaggcgcaagcacagacttcattttaaatcattcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcactccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgcggagtcattcctgtgagaaccagcctggcctgtgttaaactcttgtgccttggaaatccagatctttaaaattttatgtatttattaacatcgccattggaccccaaaa

SEQ ID NO: 176 - protein, 1223 aa, Homo sapiens
  ADAMTS14 isoform b precursor
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 177 - protein, 971 aa, Homo sapiens
  ADAMTS14 isoform 2 mature
HAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 178 - DNA, 1904 bp, Homo sapiens
  Cathepsin C
agctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 179 - protein, 463 aa, Homo sapiens
  Cathepsin C precursor
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 180 - protein, 343 aa, Homo sapiens
  Cathepsin C mature
  Dipeptidyl-peptidase 1 exclusion domain chain 1-110
  Dipeptidyl-peptidase 1 heavy chain 111-274
  Dipeptidyl-peptidase 1 light chain 275-343
DTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 181 - DNA, 2032 bp, Homo sapiens
  cathepsin F
ggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggtcaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgtgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgaaaaaaaaaaaaaaaaaaa

SEQ ID NO: 182 - protein, 484 aa, Homo sapiens [sequence omitted]

SEQ ID NO: 183 - protein, 214 aa, Homo sapiens
  cathepsin F mature
APPEWDWRSKGAVTKVKDQGMCGSCWAFSVTGNVEGQWFLNQGTLLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLLVGYGNRSDVPFWAIKNSWGTDWGEKGYYYLHRGSGACGVNTMASSAVVD

SEQ ID NO: 184 - DNA, 2943 bp, Homo sapiens
  cathepsin O
ccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggaaagtcttaatagacatcgatacttgaattctttatttcccagtgaaaactccaccgccttctatggaataaatcagttttcctatttgtttcctgaagagtttaaagccatttatttaagaagcaaaccttccaagtttcccagatactcagcagaagtacatatgtccatccccaatgtgtctttgccgttaagatttgactggagggacaagcaggttgtgacacaagtgagaaaccagcagatgtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaagatgcaagtaaaactggtgaaagattcagaatatccttttaaagcacaaaatggtctgtgccattacttttctggttcacattctggattttcaatcaaaggttattctgcatatgacttcagtgaccaagaagatgaaatggcaaaagcacttcttacctttggccctttggtagtcatagtagatgcagtgagctggcaagattatctgggaggcattatacagcatcactgctctagtggagaagcaaatcatgcagttctcataactgggtttgataaaacaggaagcactccatattggattgtgcggaattcctggggaagttcttggggagtagatggttatgcccatgtcaaaatgggaagtaatgtttgtggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactctttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtttaaaaagaaaaaaaaaaaa

SEQ ID NO: 185 - protein, 321 aa, Homo sapiens
  cathepsin O precursor
MDVRALPWLPWLLWLLCRGGGDADSRAPFTPTWPRSREREAAAFRESLNRHRYLNSLFPSENSTAFYGINQFSYLFPEEFKAIYLRSKPSKFPRYSAEVHMSIPNVSLPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKALLTFGPLVVIVDAVSWQDYLGGIIQHHCSSGEANHAVLITGFDKTGSTPYWIVRNSWGSSWGVDGYAHVKMGSNVCGIADSVSSIFV

SEQ ID NO: 186 - protein, 214 aa, Homo sapiens
  cathepsin O mature
LPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKALLTFGPLVVIVDAVSWQDYLGGIIQHHCSSGEANHAVLITGFDKTGSTPYWIVRNSWGSSWGVDGYAHVKMGSNVCGIADSVSSIFV

SEQ ID NO: 187 - DNA, 1496 bp, Homo sapiens
  cathepsin V
gctctaagcgcccggggccccgcccagtggccggcacagccaatcgcagcgcgggaaggcggtgggggcggggaaggccgcctggaaacttaaatcccgaggcgggcgaacctgcaccagaccgcggacgtctgtaatctcagaggcttgtttgctgagggtgcctgcgcagctgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaa

SEQ ID NO: 188 - protein, 334 aa, Homo sapiens
  cathepsin V precursor
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 189 - protein, 221 aa, Homo sapiens
  cathepsin V mature
LPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 190 - DNA, 2048 bp, Homo sapiens
  legumain
gcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaaaaaaaaaaaaaaaaaaaaaaaaaaaaaa

SEQ ID NO: 191 - protein, 433 aa, Homo sapiens
  legumain precursor
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 192 - protein, 306 aa, Homo sapiens
  legumain mature
VPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTN

SEQ ID NO: 193 - DNA, 1501 bp, Homo sapiens
  cathepsin Z
ggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcaacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 194 - protein, 303 aa, Homo sapiens
  cathespin Z precursor
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 195 - protein, 242 aa, Homo sapiens
  cathepsin Z mature
LPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 196 - DNA, 2654 bp, Homo sapiens
  Lysosomal acid lipase
ttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaaaaaaaaaaaaaaaaaaaaaaa

SEQ ID NO: 197 - protein, 399 aa, Homo sapiens
  Lysosomal acid lipase precursor
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 198 - protein, 378 aa, Homo sapiens
  Lysosomal acid lipase maure protein
SGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 199 - DNA, 1497 bp, Homo sapiens
  gastric lipase
agatgatgcccagatagtaagtctttttggtaatgtaatcagtggatgaggaatctgaccattgttgaaggttttgtatataagaagtcaatacaacattgaccaaaatactaaccagccagagaaacagaatcctaactatttctgaggaaactgcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaac

SEQ ID NO: 200 - protein, 398 aa, Homo sapiens
  gastric lipase precursor
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 201 - protein, 379 aa, Homo sapiens
  UNSURE (0)...(0): gastric lipase mature protein
LFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 202 - DNA, 2764 bp, Homo sapiens
  Lysosomal phospholipase A2
aagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaaatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcacgctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaaaaaaaaaaaaaaaaaaaaaaaaaaaaaaaaaaaaaaa

SEQ ID NO: 203 - protein, 412 aa, Homo sapiens
  Lysosomal phospholipase A2 precursor
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 204 - protein, 379 aa, Homo sapiens
  Lysosomal phospholipase A2 mature protein
AGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 205 - DNA, 2428 bp, Homo sapiens
  Bile salt-activated lipase
accttctgtatcagttaagtgtcaagatggaaggaacagcagtctcaagataatgcaaagagtttattcatccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctaaaaaaaaaaaaa

SEQ ID NO: 206 - protein, 745 aa, Homo sapiens
  bile-salt-stimulated lipase precursor
MLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 207 - protein, 722 aa, Homo sapiens
  Bile salt-activated lipase mature protein
AKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 208 - protein, 334 aa, Bos taurus
  cathepsin L precursor
MNPSFFLTVLCLGVASAAPKLDPNLDAHWHQWKATHRRLYGMNEEEWRRAVWEKNKKIIDLHNQEYSEGKHGFRMAMNAFGDMTNEEFRQVMNGFQNQKHKKGKLFHEPLLVDVPKSVDWTKKGYVTPVKNQGQCGSCWAFSATGALEGQMFRKTGKLVSLSEQNLVDCSRAQGNQGCNGGLMDNAFQYIKDNGGLDSEESYPYLATDTNSCNYKPECSAANDTGFVDIPQREKALMKAVATVGPISVAIDAGHTSFQFYKSGIYYDPDCSSKDLDHGVLVVGYGFEGTDSNNNKFWIVKNSWGPEWGWNGYVKMAKDQNNHCGIATAASYPTV

SEQ ID NO: 209 - protein, 217 aa, Bos taurus
  cathepsin L mature
VDWTKKGYVTPVKNQGQCGSCWAFSATGALEGQMFRKTGKLVSLSEQNLVDCSRAQGNQGCNGGLMDNAFQYIKDNGGLDSEESYPYLATDTNSCNYKPECSAANDTGFVDIPQREKALMKAVATVGPISVAIDAGHTSFQFYKSGIYYDPDCSSKDLDHGVLVVGYGFEGTDSNNNKFWIVKNSWGPEWGWNGYVKMAKDQNNHCGIATAASYPTV

SEQ ID NO: 210 - protein, 333 aa, Canis familiaris
  cathepsin L precursor
MNPSLFLTALCLGIASAAPKFDQSLNAQWYQWKATHRRLYGMNEEGWRRAVWEKNMKMIELHNREYSQGKHGFTMAMNAFGDMTNEEFRQVMNGFQNQKHKKGKMFQEPLFAEIPKSVDWREKGYVTPVKNQGQCGSCWAFSATGALEGQMFRKTGKLVSLSEQNLVDCSRAQGNEGCNGGLMDNAFRYVKDNGGLDSEESYPYLGRDTETCNYKPECSAANDTGFVDLPQREKALMKAVATLGPISVAIDAGHQSFQFYKSGIYFDPDCSSKDLDHGVLVVGYGFEGTDSNNKFWIVKNSWGPEWGWNGYVKMAKDQNNHCGIATAASYPTV

SEQ ID NO: 211 - protein, 216 aa, Canis familiaris
  cathepsin L mature
VDWREKGYVTPVKNQGQCGSCWAFSATGALEGQMFRKTGKLVSLSEQNLVDCSRAQGNEGCNGGLMDNAFRYVKDNGGLDSEESYPYLGRDTETCNYKPECSAANDTGFVDLPQREKALMKAVATLGPISVAIDAGHQSFQFYKSGIYFDPDCSSKDLDHGVLVVGYGFEGTDSNNKFWIVKNSWGPEWGWNGYVKMAKDQNNHCGIATAASYPTV

SEQ ID NO: 212 - protein, 333 aa, Cercopithecus aethiops
  cathepsin L precursor
MNPTFILAALCLGIASATLTFNHSLEAQWTKWKAMHNRLYGMNEEGWRRAVWEKNMKMIELHNQEYSQGKHSFTMAMNTFGDMTSEEFRQVMNGFQNRKPRKGKVFQEPLFYEAPRSVDWREKGYVTPVKNQGQCGSCWAFSATGALEGQMFRKTGKLVSLSEQNLVDCSGPQGNEGCNGGLMDYAFQYVADNGGLDSEESYPYEATEESCKYNPEYSVANDTGFVDIPKQEKALMKAVATVGPISVAIDAGHESFMFYKEGIYFEPDCSSEDMDHGVLVVGYGFESTESDNSKYWLVKNSWGEEWGMGGYIKMAKDRRNHCGIASAASYPTV

SEQ ID NO: 213 - protein, 220 aa, Cercopithecus aethiops
  cathepsin L mature
APRSVDWREKGYVTPVKNQGQCGSCWAFSATGALEGQMFRKTGKLVSLSEQNLVDCSGPQGNEGCNGGLMDYAFQYVADNGGLDSEESYPYEATEESCKYNPEYSVANDTGFVDIPKQEKALMKAVATVGPISVAIDAGHESFMFYKEGIYFEPDCSSEDMDHGVLVVGYGFESTESDNSKYWLVKNSWGEEWGMGGYIKMAKDRRNHCGIASAASYPTV

SEQ ID NO: 214 - protein, 218 aa, Gallus gallus
  cathepsin L mature
APRSVDWREKGYVTPVKDQGQCGSCWAFSTTGALEGQHFRTKGKLVSLSEQNLVDCSRPEGNQGCNGGLMDQAFQYVQDNGGIDSEESYPYTAKDDEDCRYKAEYNAANDTGFVDIPQGHERALMKAVASVGPVSVAIDAGHSSFQFYQSGIYYEPDCSSEDLDHGVLVVGYGFEGGKKYWIVKNSWGEKWGDKGYIYMAKDRKNHCGIATAASYPLV

SEQ ID NO: 215 - protein, 334 aa, Mus musculus
  cathepsin L precursor
MNLLLLLAVLCLGTALATPKFDQTFSAEWHQWKSTHRRLYGTNEEEWRRAIWEKNMRMIQLHNGEYSNGQHGFSMEMNAFGDMTNEEFRQVVNGYRHQKHKKGRLFQEPLMLKIPKSVDWREKGCVTPVKNQGQCGSCWAFSASGCLEGQMFLKTGKLISLSEQNLVDCSHAQGNQGCNGGLMDFAFQYIKENGGLDSEESYPYEAKDGSCKYRAEFAVANDTGFVDIPQQEKALMKAVATVGPISVAMDASHPSLQFYSSGIYYEPNCSSKNLDHGVLLVGYGYEGTDSNKNKYWLVKNSWGSEWGMEGYIKIAKDRDNHCGLATAASYPVVN

SEQ ID NO: 216 - protein, 221 aa, Mus musculus
  cathepsin L mature
IPKSVDWREKGCVTPVKNQGQCGSCWAFSASGCLEGQMFLKTGKLISLSEQNLVDCSHAQGNQGCNGGLMDFAFQYIKENGGLDSEESYPYEAKDGSCKYRAEFAVANDTGFVDIPQQEKALMKAVATVGPISVAMDASHPSLQFYSSGIYYEPNCSSKNLDHGVLLVGYGYEGTDSNKNKYWLVKNSWGSEWGMEGYIKIAKDRDNHCGLATAASYPVVN

SEQ ID NO: 217 - protein, 314 aa, Paramecium tetraurelia
  cathepsin L precursor
MMLLGASLYLNNTQEVSDEIDTANLYANWKMKYNRRYTNQRDEMYRYKVFTDNLNYIRAFYESPEEATFTLELNQFADMSQQEFAQTYLSLKVPRTAKLNAANSNFQYKGAEVDWTDNKKVKYPAVKNQGSCGSCWAFSAVGALEINTDIELNRKYELSEQDLVDCSGPYDNDGCNGGWMDSAFEYVADNGLAEAKDYPYTAKDGTCKTSVKRPYTHVQGFKDIDSCDELAQTIQERTVAVAVDANPWQFYRSGVLSKCTKNLNHGVVLVGVQADGAWKIRNSWGSSWGEAGHIRLAGGDTCGICAAPSFPILG

SEQ ID NO: 218 - protein, 205 aa, Paramecium tetraurelia
  cathepsin L mature
GAEVDWTDNKKVKYPAVKNQGSCGSCWAFSAVGALEINTDIELNRKYELSEQDLVDCSGPYDNDGCNGGWMDSAFEYVADNGLAEAKDYPYTAKDGTCKTSVKRPYTHVQGFKDIDSCDELAQTIQERTVAVAVDANPWQFYRSGVLSKCTKNLNHGVVLVGVQADGAWKIRNSWGSSWGEAGHIRLAGGDTCGICAAPSFPILG

SEQ ID NO: 219 - protein, 334 aa, Sus scrofa
  cathepsin L precursor
MKPSLFLTALCLGIASAAPKLDQNLDADWYKWKATHGRLYGMNEEGWRRAVWEKNMKMIELHNQEYSQGKHGFSMAMNAFGDMTNEEFRQVMNGFQNQKHKKGKVFHESLVLEVPKSVDWREKGYVTAVKNQGQCGSCWAFSATGALEGQMFRKTGKLVSLSEQNLVDCSRPQGNQGCNGGLMDNAFQYVKDNGGLDTEESYPYLGRETNSCTYKPECSAANDTGFVDIPQREKALMKAVATVGPISVAIDAGHSSFQFYKSGIYYDPDCSSKDLDHGVLVVGYGFEGTDSNSSKFWIVKNSWGPEWGWNGYVKMAKDQNNHCGISTAASYPTV

SEQ ID NO: 220 - protein, 217 aa, Sus scrofa
  cathepsin L mature
VDWREKGYVTAVKNQGQCGSCWAFSATGALEGQMFRKTGKLVSLSEQNLVDCSRPQGNQGCNGGLMDNAFQYVKDNGGLDTEESYPYLGRETNSCTYKPECSAANDTGFVDIPQREKALMKAVATVGPISVAIDAGHSSFQFYKSGIYYDPDCSSKDLDHGVLVVGYGFEGTDSNSSKFWIVKNSWGPEWGWNGYVKMAKDQNNHCGISTAASYPTV

SEQ ID NO: 221 - protein, 334 aa, Rattus norvegicus
  cathepsin L precursor
MTPLLLLAVLCLGTALATPKFDQTFNAQWHQWKSTHRRLYGTNEEEWRRAVWEKNMRMIQLHNGEYSNGKHGFTMEMNAFGDMTNEEFRQIVNGYRHQKHKKGRLFQEPLMLQIPKTVDWREKGCVTPVKNQGQCGSCWAFSASGCLEGQMFLKTGKLISLSEQNLVDCSHDQGNQGCNGGLMDFAFQYIKENGGLDSEESYPYEAKDGSCKYRAEYAVANDTGFVDIPQQEKALMKAVATVGPISVAMDASHPSLQFYSSGIYYEPNCSSKDLDHGVLVVGYGYEGTDSNKDKYWLVKNSWGKEWGMDGYIKIAKDRNNHCGLATAASYPIVN

SEQ ID NO: 222 - protein, 221 aa, Rattus norvegicus
  cathepsin L mature
IPKTVDWREKGCVTPVKNQGQCGSCWAFSASGCLEGQMFLKTGKLISLSEQNLVDCSHDQGNQGCNGGLMDFAFQYIKENGGLDSEESYPYEAKDGSCKYRAEYAVANDTGFVDIPQQEKALMKAVATVGPISVAMDASHPSLQFYSSGIYYEPNCSSKDLDHGVLVVGYGYEGTDSNKDKYWLVKNSWGKEWGMDGYIKIAKDRNNHCGLATAASYPIVN

SEQ ID NO: 223 - protein, 217 aa, Ovis aries
  cathepsin L mature
VPKSVDWTKKGYVTPVKNQGQCGSCWAFSATGALEGQMFRKTGKLVSLSEQNLVDSSRPQGNQGCNGGLMDNAFQYIKENGGLDSEESYPYEATDTSCNYKPEYSAAKDTGFVDIPQREKALMKAVATVGPISVAIDAGHSSFQFYKSGIYYDPDCSSKDLDHGVLVVGYGFEGTNNKFWIVKNSWGPEWGNKGYVKMAKDQNNHCGIATAASYPTV

SEQ ID NO: 224 - DNA, 6630 bp, Artificial Sequence
  HZ24 with PH20 and DHFR (Gen1/Gen2)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 225 - protein, 482 aa, Homo sapiens
  precursor soluble rHuPH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 226 - protein, 447 aa, Homo sapiens [sequence omitted]

SEQ ID NO: 227 - protein, 446 aa, Homo sapiens
  soluble rHuPH20 1-446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 228 - protein, 445 aa, Homo sapiens
  soluble rHuPH20 1-445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 229 - protein, 444 aa, Homo sapiens
  soluble rHuPH20 1-444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 230 - protein, 443 aa, Homo sapiens
  soluble rHuPH20 1-443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 231 - protein, 442 aa, Homo sapiens
  soluble rHuPH20 1-442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 232 - protein, 509 aa, Homo sapiens
  precursor PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 233 - protein, 474 aa, Homo sapiens
  mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 234 - protein, 333 aa, Homo sapiens [sequence omitted]

SEQ ID NO: 235 - protein, 5 aa, Artificial Sequence
  6 x His tag
HHHHH

SEQ ID NO: 236 - protein, 8 aa, Artificial Sequence
  Flag Tag
DYKDDDDK

SEQ ID NO: 237 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 238 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 239 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 240 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 241 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 242 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 243 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 244 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 245 - protein, 412 aa, Mus musculus
  hyaluronidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 246 - protein, 435 aa, Sus scrofa
  hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 247 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 248 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 249 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 250 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 251 - protein, 545 aa, Oryctolagus cuniculus
  PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 252 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 253 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 254 - protein, 510 aa, Macaca fascicularis
  PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 255 - protein, 529 aa, Cavia porcellus
  PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 256 - protein, 512 aa, Rattus norvegicus
  PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 257 - protein, 512 aa, Mus musculus
  PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 258 - protein, 807 aa, Staphylococcus aureus
  hyaluronidase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 259 - protein, 371 aa, Streptococcus pyogenes
  hyaluronidase
  bacteriophage H4489A
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 260 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 261 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 262 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 263 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 264 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 265 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 266 - protein, 553 aa, Bos taurus
  PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 267 - protein, 114 aa, Ovis aries
  PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 268 - DNA, 1446 bp, Homo sapiens
  DNA encoding soluble rHuPH20 "precursor"
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 269 - protein, 509 aa, Homo sapiens
  PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 270 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 271 - protein, 520 aa, Ovis aries
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 272 - protein, 474 aa, Bos taurus
  PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 273 - protein, 517 aa, Ovis aries
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 274 - DNA, 1620 bp, Ovis aries
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 275 - protein, 793 aa, Arthrobacter species
  hyaluronan lyase
  strain FB24
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 276 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 277 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 278 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 279 - protein, 1072 aa, Streptococcus agalactiae
  hyaluronan lyase
  18RS21
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 280 - protein, 1081 aa, Streptococcus agalactiae
  hyaluronan lyase
  serotype Ia
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 281 - protein, 984 aa, Streptococcus agalactiae
  hyaluronan lyase
  serotype III
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 282 - protein, 807 aa, Staphylococcus aureus; identical to SEQ ID NO: 258
  hyaluronan lyase
  strain COL

SEQ ID NO: 283 - protein, 420 aa, Staphylococcus aureus
  hyaluronan lyase
  strain MRSA252
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 284 - protein, 806 aa, Staphylococcus aureus
  hyaluronan lyase
  strain MRSA252
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 285 - protein, 815 aa, Staphylococcus aureus
  hyaluronan lyase
  strain MSSA476
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 286 - protein, 807 aa, Staphylococcus aureus; identical to SEQ ID NO: 258
  hyaluronan lyase
  strain NCTC 8325

SEQ ID NO: 287 - protein, 809 aa, Staphylococcus aureus
  hyaluronan lyase
  strain bovine RF122
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 288 - protein, 807 aa, Staphylococcus aureus
  hyaluronan lyase
  strain bovine RF122
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 289 - protein, 807 aa, Staphylococcus aureus; identical to SEQ ID NO: 258
  hyaluronan lyase
  strain USA300

SEQ ID NO: 290 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 291 - protein, 1078 aa, Streptococcus pneumoniae
  hyaluronan lyase
  strain ATCC BAA-255/R6
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 292 - protein, 1067 aa, Streptococcus pneumoniae
  hyaluronan lyase
  strain D39/NCTC 7466 serotype 2
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 293 - protein, 805 aa, Streptococcus pyogenes
  hyaluronan lyase serotype M1
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 294 - protein, 780 aa, Streptococcus pyogenes
  hyaluronan lyase serotype M2  strain MGAS10270
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 295 - protein, 868 aa, Streptococcus pyogenes
  hyaluronan lyase serotype M4 strain MGAS10750
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 296 - protein, 828 aa, Streptococcus pyogenes
  hyaluronan lyase
  serotype M6
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 297 - protein, 556 aa, Streptococcus pyogenes
  hyaluronan lyase serotype M12 strain MGAS2096
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 298 - protein, 635 aa, Streptococcus pyogenes
  hyaluronan lyase serotype M12 strain MGAS2096
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 299 - protein, 828 aa, Streptococcus pyogenes
  hyaluronan lyase serotype M12 strain MGAS9429
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 300 - protein, 828 aa, Streptococcus pyogenes
  hyaluronan lyase
  serotype M28
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 301 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 302 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 303 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 304 - protein, 802 aa, Vibrio fischeri
  hyaluronan lyase
  strain ATCC 700601 / ES114
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 305 - protein, 517 aa, Synechococcus species
  hyaluronan lyase
  strain RCC307
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 306 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 307 - protein, 700 aa, Pedobacter heparinus
  chondroitin AC lyase
MKKLFVTCIVFFSILSPALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 308 - protein, 844 aa, Victivallis vadensis
  chondroitin AC lyase
  ATCC BAA-548
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 309 - DNA, 4344 bp, Homo sapiens
  MMP-24
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgaaaaaaaaaaa

SEQ ID NO: 310 - protein, 645 aa, Homo sapiens
  MMP-24 precursor
MPRSRGGRAAPGPPPPPPPPGQAPRWSRWRVPGRLLLLLLPALCCLPGAARAAAAAAGAGNRAAVAVAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 311 - protein, 490 aa, Homo sapiens
  MMP-24 mature
YALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 312 - DNA, 3565 bp, Homo sapiens
  MMP-25
gattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaaaaaaaaaaaaa

SEQ ID NO: 313 - protein, 562 aa, Homo sapiens
  MMP-25 precursor
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 314 - protein, 455 aa, Homo sapiens
  MMP-25 mature
YALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 315 - DNA, 1919 bp, Homo sapiens
  MMP-21
atgctcgccgcctccatcttccgtccgacactgctgctctgctggctggctgctccctggcccacccagcccgagagtctcttccacagccgggaccgctcggacctggagccgtccccactgcgccaggccaagcccattgccgacctccacgctgctcagcggttcctgtccagatacggctggtcaggggtgtgggcggcctgggggcccagtcccgaggggccgccggagacccccaagggcgccgccctggccgaggcggtgcgcaggttccagcgggcgaacgcgctgccggccagcggggagctggacgcggccaccctagcggccatgaaccggccgcgctgcggggtcccggacatgcgcccaccgcccccctccgccccgccttcgcccccgggcccgccccccagagcccgctccaggcgctccccgcgggcgccgctgtccttgtcccggcggggttggcagccccggggctaccccgacggcggagctgcccaggccttctccaagaggacgctgagctggcggctgctgggcgaggccctgagcagccaactgtccgtggccgaccagcggcgcattgtggcgctggccttcaggatgtggagcgaggtgacgccgctggacttccgcgaggacctggccgcccccggggccgcggtcgacatcaagctgggctttgggagaggccggcacctgggctgtccgcgggccttcgatgggagcgggcaggagtttgcacacgcctggcgcctaggtgacattcactttgacgacgacgagcacttcacacctcccaccagtgacacgggcatcagccttctcaaggtggccgtccatgaaattggccatgtcctgggcttgcctcacacctacaggacgggatccataatgcaaccaaattacattccccaggagcctgcctttgagttggactggtcagacaggaaagcaattcaaaagctgtatggctcctgtgagggatcatttgatactgcgtttgactggattcgcaaagagagaaaccaatatggagaggtgatggtgagatttagcacatatttcttccgtaacagctggtactggctttatgaaaatcgaaacaataggacacgctatggggaccctatccaaatcctcactggctggcctggaatcccaacacacaacatagatgcctttgttcacatctggacatggaaaagagatgaacgttatttttttcaaggaaatcaatactggagatatgacagtgacaaggatcaggccctcacagaagatgaacaaggaaaaagctatcccaaattgatttcagaaggatttcctggcatcccaagtcccctagacacggcgttttatgaccgaagacagaagttaatttacttcttcaaggagtcccttgtatttgcatttgatgtcaacagaaatcgagtacttaattcttatccaaagaggattactgaagtttttccagcagtaataccacaaaatcatcctttcagaaatatagattccgcttattactcctatgcatacaactccattttctttttcaaaggcaatgcatactggaaggtagttaatgacaaggacaaacaacagaattcctggcttcctgctaatggcttatttccaaaaaagtttatttcagagaagtggtttgatgtttgtgacgtccatatctccacactgaacatgtaataagaaaaagtaggaaatggagggtcataggacttcgctaaaattctgatactgtttacaaagaaaaccggattttcagtagctgaagaaaatatggcactgtaagttaaaacccaatgggaaaagccttagttgaacttttaaaatacttgatttaaaaacaattgctcaggcaaaacataattcataaactaaaaggtttaaaaaaa

SEQ ID NO: 316 - protein, 569 aa, Homo sapiens [sequence omitted]

SEQ ID NO: 317 - protein, 425 aa, Homo sapiens
  MMP-21 mature
SPRAPLSLSRRGWQPRGYPDGGAAQAFSKRTLSWRLLGEALSSQLSAADQRRIVALAFRMWSEVTPLDFREDLAAPGAAVDIKLGFGRGRHLGCPRAFDGSGQEFAHAWRLGDIHFDDDEHFTPPTSDTGISLLKVAVHEIGHVLGLPHTYRTGSIMQPNYIPQEPAFELDWSDRKAIQKLYGSCEGSFDTAFDWIRKERNQYGEVMVRFSTYFFRNSWYWLYENRNNRTRYGDPIQILTGWPGIPTHNIDAFVHIWTWKRDERYFFQGNQYWRYDSDKDQALTEDEQGKSYPKLISEGFPGIPSPLDTAFYDRRQKLIYFFKESLVFAFDVNRNRVLNSYPKRITEVFPAVIPQNHPFRNIDSAYYSYAYNSIFFFKGNAYWKVVNDKDKQQNSWLPANGLFPKKFISEKWFDVCDVHISTLNM

SEQ ID NO: 318 - DNA, 1246 bp, Homo sapiens
  MMP-23
ctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctgaaaaaaa

SEQ ID NO: 319 - protein, 390 aa, Homo sapiens
  MMP-23 precursor
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 320 - protein, 312 aa, Homo sapiens
  MMP-23 mature
YTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 321 - DNA, 1647 bp, Homo sapiens
  MMP-27
gcttcagctgaagaaagagaggaatgaagcgccttctgcttctgtttttgttctttataacattttcttctgcatttcccttagtccggatgacggaaaatgaagaaaatatgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggaacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaagggttcccgcagagagtggtaaaacactttcctggaatcagtatccgtgttgatgctgctttccagtacaaaggattcttctttttcagccgtggatcaaagcaatttgaatacgacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaac

SEQ ID NO: 322 - protein, 513 aa, Homo sapiens
  MMP-27 precursor
MKRLLLLFLFFITFSSAFPLVRMMENEENVQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 323 - protein, 415 aa, Homo sapiens
  MMP-27 mature
YGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 324 - DNA, 2480 bp, Homo sapiens
  MMP-28
tccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaaggtacagttcctttcaagaggtaacagcactgggatccaagcagggggatgaaaaactcagcagagaaattcgagaccattttgcaagactgtgcccttctcctcaggaccccctggctcagttcttgaaaaacggtgtcatatttagtcagaggccccacccccaggaagcatggatggggatgaaggcacaggcgtctccaacctcagaggccctttgtggggtcaggacacagagtgggagggagactgatgcaggcctaccagtccctggctttttgtctggggctggaataaagaggtgccttcagctggtgggccgagaggcaggaagcagccttaaaaaaaaaaaaaaa

SEQ ID NO: 325 - protein, 520 aa, Homo sapiens
  MMP-28 precursor
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 326 - protein, 398 aa, Homo sapiens
  MMP-28 mature
FAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 327 - protein, 450 aa, Homo sapiens
  Mature MMP-1 with prodomain
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 328 - protein, 450 aa, Artificial Sequence
  MMP-1 variant L95K
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHKTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 329 - protein, 450 aa, Artificial Sequence
  MMP-1 variant L95I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHITYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 330 - protein, 450 aa, Artificial Sequence
  MMP-1 variant D105E
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPELPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 331 - protein, 450 aa, Artificial Sequence
  MMP-1 variant D105R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPRLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 332 - protein, 450 aa, Artificial Sequence
  MMP-1 variant D105N
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPNLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 333 - protein, 450 aa, Artificial Sequence
  MMP-1 variant D105T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPTLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 334 - protein, 450 aa, Artificial Sequence
  MMP-1 variant D105S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPSLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 335 - protein, 450 aa, Artificial Sequence
  MMP-1 variant D105G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPGLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 336 - protein, 450 aa, Artificial Sequence
  MMP-1 variant D105F
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPFLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 337 - protein, 450 aa, Artificial Sequence
  MMP-1 variant D105W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPWLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 338 - protein, 450 aa, Artificial Sequence
  MMP-1 variant D105I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPILPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 339 - protein, 450 aa, Artificial Sequence
  MMP-1 variant D105L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPLLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 340 - protein, 450 aa, Artificial Sequence
  MMP-1 variant D105A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPALPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 341 - protein, 450 aa, Artificial Sequence
  MMP-1 variant R150D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHDDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 342 - protein, 450 aa, Artificial Sequence
  MMP-1 variant R150H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHHDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 343 - protein, 450 aa, Artificial Sequence
  MMP-1 variant R150I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHIDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 344 - protein, 450 aa, Artificial Sequence
  MMP-1 variant R150V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHVDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 345 - protein, 450 aa, Artificial Sequence
  MMP-1 variant R150P
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHPDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 346 - protein, 450 aa, Artificial Sequence
  MMP-1 variant D151G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRGNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 347 - protein, 450 aa, Artificial Sequence
  MMP-1 variant F155L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPLDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 348 - protein, 450 aa, Artificial Sequence
  MMP-1 variant F155A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPADGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 349 - protein, 450 aa, Artificial Sequence
  MMP-1 variant D156H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFHGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 350 - protein, 450 aa, Artificial Sequence
  MMP-1 variant D156K
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFKGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 351 - protein, 450 aa, Artificial Sequence
  MMP-1 variant D156R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFRGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 352 - protein, 450 aa, Artificial Sequence
  MMP-1 variant D156T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFTGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 353 - protein, 450 aa, Artificial Sequence
  MMP-1 variant D156M
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFMGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 354 - protein, 450 aa, Artificial Sequence
  MMP-1 variant D156W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFWGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 355 - protein, 450 aa, Artificial Sequence
  MMP-1 variant D156V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFVGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 356 - protein, 450 aa, Artificial Sequence
  MMP-1 variant D156L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFLGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 357 - protein, 450 aa, Artificial Sequence
  MMP-1 variant D156A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFAGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 358 - protein, 450 aa, Artificial Sequence
  MMP-1 variant G159C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPCGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 359 - protein, 450 aa, Artificial Sequence
  MMP-1 variant G159T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPTGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 360 - protein, 450 aa, Artificial Sequence
  MMP-1 variant G159M
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPMGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 361 - protein, 450 aa, Artificial Sequence
  MMP-1 variant G159W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPWGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 362 - protein, 450 aa, Artificial Sequence
  MMP-1 variant G159I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPIGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 363 - protein, 450 aa, Artificial Sequence
  MMP-1 variant G159V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPVGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 364 - protein, 450 aa, Artificial Sequence
  MMP-1 variant G159L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPLGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 365 - protein, 450 aa, Artificial Sequence
  MMP-1 variant A176F
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDFHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 366 - protein, 450 aa, Artificial Sequence
  MMP-1 variant A176W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDWHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 367 - protein, 450 aa, Artificial Sequence
  MMP-1 variant D179C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFCEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 368 - protein, 450 aa, Artificial Sequence
  MMP-1 variant D179N
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFNEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 369 - protein, 450 aa, Artificial Sequence
  MMP-1 variant D179V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFVEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 370 - protein, 450 aa, Artificial Sequence
  MMP-1 variant E180D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDDDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 371 - protein, 450 aa, Artificial Sequence
  MMP-1 variant E180R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDRDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 372 - protein, 450 aa, Artificial Sequence
  MMP-1 variant E180N
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDNDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 373 - protein, 450 aa, Artificial Sequence
  MMP-1 variant E180T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDTDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 374 - protein, 450 aa, Artificial Sequence
  MMP-1 variant E180Y
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDYDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 375 - protein, 450 aa, Artificial Sequence
  MMP-1 variant E180S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDSDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 376 - protein, 450 aa, Artificial Sequence
  MMP-1 variant E180G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDGDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 377 - protein, 450 aa, Artificial Sequence
  MMP-1 variant E180F
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDFDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 378 - protein, 450 aa, Artificial Sequence
  MMP-1 variant D181K
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEKERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 379 - protein, 450 aa, Artificial Sequence
  MMP-1 variant D181C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDECERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 380 - protein, 450 aa, Artificial Sequence
  MMP-1 variant D181T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDETERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 381 - protein, 450 aa, Artificial Sequence
  MMP-1 variant D181G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEGERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 382 - protein, 450 aa, Artificial Sequence
  MMP-1 variant D181L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDELERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 383 - protein, 450 aa, Artificial Sequence
  MMP-1 variant E182Q
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDQRWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 384 - protein, 450 aa, Artificial Sequence
  MMP-1 variant E182T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDYRWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 385 - protein, 450 aa, Artificial Sequence
  MMP-1 variant E182G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDGRWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 386 - protein, 450 aa, Artificial Sequence
  MMP-1 variant E182M
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDMRWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 387 - protein, 450 aa, Artificial Sequence
  MMP-1 variant T185D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWDNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 388 - protein, 450 aa, Artificial Sequence
  MMP-1 variant T185E
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWENNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 389 - protein, 450 aa, Artificial Sequence
  MMP-1 variant T185H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWHNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 390 - protein, 450 aa, Artificial Sequence
  MMP-1 variant T185R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWRNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 391 - protein, 450 aa, Artificial Sequence
  MMP-1 variant T185Q
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWQNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 392 - protein, 450 aa, Artificial Sequence
  MMP-1 variant T185Y
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWYNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 393 - protein, 450 aa, Artificial Sequence
  MMP-1 variant T185G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWGNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 394 - protein, 450 aa, Artificial Sequence; identical to SEQ ID NO: 327
  MMP-1 variant T185V

SEQ ID NO: 395 - protein, 450 aa, Artificial Sequence
  MMP-1 variant T185A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWANNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 396 - protein, 450 aa, Artificial Sequence
  MMP-1 variant N187H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNHFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 397 - protein, 450 aa, Artificial Sequence
  MMP-1 variant N187K
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNKFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 398 - protein, 450 aa, Artificial Sequence
  MMP-1 variant N187R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNRFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 399 - protein, 450 aa, Artificial Sequence
  MMP-1 variant N187C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNCFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 400 - protein, 450 aa, Artificial Sequence
  MMP-1 variant N187G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNGFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 401 - protein, 450 aa, Artificial Sequence
  MMP-1 variant N187F
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNFFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 402 - protein, 450 aa, Artificial Sequence
  MMP-1 variant N187M
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNMFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 403 - protein, 450 aa, Artificial Sequence
  MMP-1 variant N187W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNWFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 404 - protein, 450 aa, Artificial Sequence
  MMP-1 variant N187I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNIFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 405 - protein, 450 aa, Artificial Sequence
  MMP-1 variant N187A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNAFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 406 - protein, 450 aa, Artificial Sequence
  MMP-1 variant R195D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHDVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 407 - protein, 450 aa, Artificial Sequence
  MMP-1 variant R195C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHCVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 408 - protein, 450 aa, Artificial Sequence
  MMP-1 variant R195Q
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHQVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 409 - protein, 450 aa, Artificial Sequence
  MMP-1 variant R195G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHGVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 410 - protein, 450 aa, Artificial Sequence
  MMP-1 variant R195W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHWVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 411 - protein, 450 aa, Artificial Sequence
  MMP-1 variant R195V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHVVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 412 - protein, 450 aa, Artificial Sequence
  MMP-1 variant R195L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHLVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 413 - protein, 450 aa, Artificial Sequence
  MMP-1 variant R195A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHAVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 414 - protein, 450 aa, Artificial Sequence
  MMP-1 variant A198G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAGHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 415 - protein, 450 aa, Artificial Sequence
  MMP-1 variant A198M
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAMHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 416 - protein, 450 aa, Artificial Sequence
  MMP-1 variant A198L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVALHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 417 - protein, 450 aa, Artificial Sequence
  MMP-1 variant G206S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLSLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 418 - protein, 450 aa, Artificial Sequence
  MMP-1 variant G206A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLALSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 419 - protein, 450 aa, Artificial Sequence
  MMP-1 variant S210V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHVTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 420 - protein, 450 aa, Artificial Sequence
  MMP-1 variant S210A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHATDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 421 - protein, 450 aa, Artificial Sequence
  MMP-1 variant Y218S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMSPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 422 - protein, 450 aa, Artificial Sequence
  MMP-1 variant F223E
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTESGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 423 - protein, 450 aa, Artificial Sequence
  MMP-1 variant F223K
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTKSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 424 - protein, 450 aa, Artificial Sequence
  MMP-1 variant F223C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTCSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 425 - protein, 450 aa, Artificial Sequence
  MMP-1 variant F223S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTSSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 426 - protein, 450 aa, Artificial Sequence
  MMP-1 variant F223G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTGSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 427 - protein, 450 aa, Artificial Sequence
  MMP-1 variant F223M
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTMSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 428 - protein, 450 aa, Artificial Sequence
  MMP-1 variant F223A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTASGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 429 - protein, 450 aa, Artificial Sequence
  MMP-1 variant V227D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDDQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 430 - protein, 450 aa, Artificial Sequence
  MMP-1 variant V227E
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDEQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 431 - protein, 450 aa, Artificial Sequence
  MMP-1 variant V227H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDHQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 432 - protein, 450 aa, Artificial Sequence
  MMP-1 variant V227R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDRQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 433 - protein, 450 aa, Artificial Sequence
  MMP-1 variant V227C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDCQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 434 - protein, 450 aa, Artificial Sequence
  MMP-1 variant V227Q
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDQQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 435 - protein, 450 aa, Artificial Sequence
  MMP-1 variant V227S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDSQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 436 - protein, 450 aa, Artificial Sequence
  MMP-1 variant V227G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDGQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 437 - protein, 450 aa, Artificial Sequence
  MMP-1 variant V227W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDWQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 438 - protein, 450 aa, Artificial Sequence
  MMP-1 variant V227L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDLQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 439 - protein, 450 aa, Artificial Sequence
  MMP-1 variant Q228P
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVPLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 440 - protein, 450 aa, Artificial Sequence
  MMP-1 variant L229T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQTAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 441 - protein, 450 aa, Artificial Sequence
  MMP-1 variant L229I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQIAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 442 - protein, 450 aa, Artificial Sequence
  MMP-1 variant L229A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQAAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 443 - protein, 450 aa, Artificial Sequence
  MMP-1 variant D233E
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDEIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 444 - protein, 450 aa, Artificial Sequence
  MMP-1 variant I234E
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDEDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 445 - protein, 450 aa, Artificial Sequence
  MMP-1 variant I234Q
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDQDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 446 - protein, 450 aa, Artificial Sequence
  MMP-1 variant I234T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDTDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 447 - protein, 450 aa, Artificial Sequence
  MMP-1 variant I234A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDADGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 448 - protein, 450 aa, Artificial Sequence
  MMP-1 variant I240C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQACYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 449 - protein, 450 aa, Artificial Sequence
  MMP-1 variant I240S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQASYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 450 - protein, 450 aa, Artificial Sequence
  MMP-1 variant I240A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAAYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 451 - protein, 450 aa, Artificial Sequence
  MMP-1 variant E100R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIRNYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 452 - protein, 450 aa, Artificial Sequence
  MMP-1 variant E100N
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRINNYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 453 - protein, 450 aa, Artificial Sequence
  MMP-1 variant E100T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRITNYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 454 - protein, 450 aa, Artificial Sequence
  MMP-1 variant E100S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRISNYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 455 - protein, 450 aa, Artificial Sequence
  MMP-1 variant E100F
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIFNYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 456 - protein, 450 aa, Artificial Sequence
  MMP-1 variant E100I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIINYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 457 - protein, 450 aa, Artificial Sequence
  MMP-1 variant E100V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIVNYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 458 - protein, 450 aa, Artificial Sequence
  MMP-1 variant T103Y
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYYPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 459 - protein, 450 aa, Artificial Sequence
  MMP-1 variant S153T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNTPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 460 - protein, 450 aa, Artificial Sequence
  MMP-1 variant G171D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPDIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 461 - protein, 450 aa, Artificial Sequence
  MMP-1 variant G171E
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPEIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 462 - protein, 450 aa, Artificial Sequence
  MMP-1 variant G171P
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPPIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 463 - protein, 450 aa, Artificial Sequence
  MMP-1 variant E190D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFRDYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 464 - protein, 450 aa, Artificial Sequence
  MMP-1 variant E190Y
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFRYYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 465 - protein, 450 aa, Artificial Sequence
  MMP-1 variant E190G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFRGYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 466 - protein, 450 aa, Artificial Sequence
  MMP-1 variant Y191V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREVNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 467 - protein, 450 aa, Artificial Sequence
  MMP-1 variant N192D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYDLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 468 - protein, 450 aa, Artificial Sequence
  MMP-1 variant N192H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYHLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 469 - protein, 450 aa, Artificial Sequence
  MMP-1 variant N192C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYCLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 470 - protein, 450 aa, Artificial Sequence
  MMP-1 variant N192S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYSLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 471 - protein, 450 aa, Artificial Sequence
  MMP-1 variant H194P
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLPRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 472 - protein, 450 aa, Artificial Sequence
  MMP-1 variant L207R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGRSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 473 - protein, 450 aa, Artificial Sequence
  MMP-1 variant L207G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGGSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 474 - protein, 450 aa, Artificial Sequence
  MMP-1 variant L207I
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGISHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 475 - protein, 450 aa, Artificial Sequence
  MMP-1 variant L207V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGVSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 476 - protein, 450 aa, Artificial Sequence
  MMP-1 variant D212H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTHIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 477 - protein, 450 aa, Artificial Sequence
  MMP-1 variant D212G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTGIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 478 - protein, 450 aa, Artificial Sequence
  MMP-1 variant A230V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLVQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 479 - protein, 450 aa, Artificial Sequence
  MMP-1 variant T84F
FPATLETQEQDVDLVQKYLEKYYNLKNDGRQVEKRRNSGPVVEKLKQMQEFFGLKVTGKPDAETLKVMKQPRCGVPDVAQFVLFEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 480 - protein, 450 aa, Artificial Sequence
  MMP-1 variant E85F
FPATLETQEQDVDLVQKYLEKYYNLKNDGRQVEKRRNSGPVVEKLKQMQEFFGLKVTGKPDAETLKVMKQPRCGVPDVAQFVLTFGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 481 - protein, 450 aa, Artificial Sequence
  MMP-1 variant R98D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYDIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 482 - protein, 450 aa, Artificial Sequence
  MMP-1 variant I99Q
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRQENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 483 - protein, 450 aa, Artificial Sequence
  MMP-1 variant P104M
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTMDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 484 - protein, 450 aa, Artificial Sequence
  MMP-1 variant P104A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTADLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 485 - protein, 450 aa, Artificial Sequence
  MMP-1 variant L106C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDCPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 486 - protein, 450 aa, Artificial Sequence
  MMP-1 variant L106S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDSPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 487 - protein, 450 aa, Artificial Sequence
  MMP-1 variant A109H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRHDVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 488 - protein, 450 aa, Artificial Sequence
  MMP-1 variant D110A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRAAVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 489 - protein, 450 aa, Artificial Sequence
  MMP-1 variant V111R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADRDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 490 - protein, 450 aa, Artificial Sequence
  MMP-1 variant D112S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVSHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 491 - protein, 450 aa, Artificial Sequence
  MMP-1 variant A118T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKTFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 492 - protein, 450 aa, Artificial Sequence
  MMP-1 variant S123V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWVNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 493 - protein, 450 aa, Artificial Sequence
  MMP-1 variant N124D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSDVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 494 - protein, 450 aa, Artificial Sequence
  MMP-1 variant T126S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVSPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 495 - protein, 450 aa, Artificial Sequence
  MMP-1 variant G147P
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRPDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 496 - protein, 450 aa, Artificial Sequence
  MMP-1 variant N152S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDSSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 497 - protein, 450 aa, Artificial Sequence
  MMP-1 variant N152A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDASPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 498 - protein, 450 aa, Artificial Sequence
  MMP-1 variant P158K
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGKGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 499 - protein, 450 aa, Artificial Sequence
  MMP-1 variant P158N
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGNGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 500 - protein, 450 aa, Artificial Sequence
  MMP-1 variant P158T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGTGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 501 - protein, 450 aa, Artificial Sequence
  MMP-1 variant P158G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGGGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 502 - protein, 450 aa, Artificial Sequence
  MMP-1 variant P170D
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGDGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 503 - protein, 450 aa, Artificial Sequence
  MMP-1 variant P170A
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGAGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 504 - protein, 450 aa, Artificial Sequence
  MMP-1 variant F178T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHTDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 505 - protein, 450 aa, Artificial Sequence
  MMP-1 variant F178L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHLDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 506 - protein, 450 aa, Artificial Sequence
  MMP-1 variant R183S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDESWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 507 - protein, 450 aa, Artificial Sequence
  MMP-1 variant R183G
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDEGWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 508 - protein, 450 aa, Artificial Sequence
  MMP-1 variant F188V
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNVREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 509 - protein, 450 aa, Artificial Sequence
  MMP-1 variant R189N
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFNEYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 510 - protein, 450 aa, Artificial Sequence
  MMP-1 variant R189Q
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFQEYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 511 - protein, 450 aa, Artificial Sequence
  MMP-1 variant R189T
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFTEYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 512 - protein, 450 aa, Artificial Sequence
  MMP-1 variant A197C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVCAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 513 - protein, 450 aa, Artificial Sequence
  MMP-1 variant S208R
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLRHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 514 - protein, 450 aa, Artificial Sequence
  MMP-1 variant S208L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLLHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 515 - protein, 450 aa, Artificial Sequence
  MMP-1 variant T211L
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSLDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 516 - protein, 450 aa, Artificial Sequence
  MMP-1 variant I237N
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGNQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 517 - protein, 450 aa, Artificial Sequence
  MMP-1 variant I237W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGWQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 518 - protein, 450 aa, Artificial Sequence
  MMP-1 variant I237W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGLQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 519 - protein, 450 aa, Artificial Sequence
  MMP-1 variant I251S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPSGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 520 - protein, 450 aa, Artificial Sequence
  MMP-1 variant I251W
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPWGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 521 - protein, 450 aa, Artificial Sequence
  MMP-1 variant Q254S
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPSTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 522 - protein, 450 aa, Artificial Sequence
  MMP-1 variant T255H
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQHPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 523 - protein, 450 aa, Artificial Sequence
  MMP-1 variant P256C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTCKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 524 - protein, 450 aa, Artificial Sequence
  MMP-1 variant P256C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPTACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 525 - protein, 450 aa, Artificial Sequence
  MMP-1 variant P256C
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPPACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 526 - protein, 450 aa, Artificial Sequence
  MMP-1 variant A258P
FPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKPCDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 527 - protein, 450 aa, Sus scrofa
  Pig MMP-1 zymogen
PAATSETQEQDVEIVQKYLKNYYNLNSDGVPVEKKRNSGLVVEKLKQMQQFFGLKVTGKPDAETLNVMKQPRCGVPDVAEFVLTPGNPRWENTHLTYRIENYTPDLSREDVDRAIEKAFQLWSNVSPLTFTKVSEGQADIMISFVRGDHRDNSPFDGPGGNLAHAFQPGPGIGGDAHFDEDERWTKNFRDYNLYRVAAHELGHSLGLSHSTDIGALMYPNYIYTGDVQLSQDDIDGIQAIYGPSENPVQPSGPQTPQVCDSKLTFDAITTLRGELMFFKDRFYMRTNSFYPEVELNFISVFWPQVPNGLQAAYEIADRDEVRFFKGNKYWAVRGQDVLYGYPKDIHRSFGFPSTVKNIDAAVFEEDTGKTYFFVAHECWRYDEYKQSMDTGYPKMIAEEFPGIGNKVDAVFQKDGFLYFFHGTRQYQFDFKTKRILTLQKANSWFNCRKN

SEQ ID NO: 528 - protein, 450 aa, Oryctolagus cuniculus
  Rabbit MMP-1 zymogen
FPAASETQEQDVEMVQKYLENYYNLKDDWRKIPKQRGNGLAVEKLKQMQEFFGLKVTGKPDAETLKMMKQPRCGVPDVAQFVLTPGNPRWEQTHLTYRIENYTPDLSRADVDNAIEKAFQLWSNVTPLTFTKVSKGQADIMISFVRGDHRDNSPFDGPEGQLAHAFQPGLGIGGDVHFDEDDRWTKDFRNYNLYRVAAHELGHSLGLSHSTDIGALMYPNYMFSGDVQLAQDDIDGIQAIYGPSQNPSQPVGPQTPKVCDSKLTFDAITTIRGEIMFFKDRFYMRANPYYSEVELNFISVFWPHLPNGLQAAYEVAHRDEILFFKGNKYWTVQGQNELPGYPKDIHSSFGFPRSVNHIDAAVSEEDTGKTYFFVANKYWRYDEYKRSMDAGYPKMIEYDFPGIGNKVDAVFKKDGFFYFFHGTRQYKFDPKTKRILTLQKANSWFNCRKN

SEQ ID NO: 529 - protein, 451 aa, Bos taurus
  Cow MMP-1
FPAATSETQEQDVETVKKYLENYYNLNSNGKKVERQRNGGLITEKLKQMQKFFGLRVTGKPDAETLNVMKQPRCGVPDVAPFVLTPGKSCWENTNLTYRIENYTPDLSRADVDQAIEKAFQLWSNVTPLTFTKVSEGQADIMISFVRGDHRDNSPFDGPGGNLAHAFQPGAGIGGDAHFDDDEWWTSNFQDYNLYRVAAHEFGHSLGLAHSTDIGALMYPSYTFSGDVQLSQDDIDGIQAIYGPSQNPTQPVGPQTPEVCDSKLTFDAITTIRGEVMFFKDRFYMRTNPLYPEVELNFISVFWPQLPNGLQAAYEVADRDEVRFFKGNKYWAVKGQDVLRGYPRDIYRSFGFPRTVKSIDAAVSEEDTGKTYFFVANKCWRYDEYKQSMDAGYPKMIAEDFPGIGNKVDAVFQKGGFFYFFHGRRQYKFDPQTKRILTLLKANSWFNCRKN

SEQ ID NO: 530 - protein, 451 aa, Equus caballus
  Horse MMP-1
FPTVPSETREEDVEMVQKYLENYYNLKSDGEQIEKQRHRSPVVEKLKQMQEFFGLKVTGKPDAETLNVMKQPRCGVPDVAEFVLTEGNPRWENTHLTYRIENYTPDLPRADVDQAIEKAFQLWSNVSPLTFTKVSEGQADIMISFVRGDHRDNSPFDGPGGNLAHAFQPGPRIGGDAHFDEDETWTSNFRNYNLYRVAAHEFGHSLGLSHSTDIGALMYPNYFFTGDVQLSQDDINGIQAIYGPSQNPIQPIGPQTPEVCDSKLTFDAITTIRGEVMFFKDRFYMRINPYYPEAELNFISIFWPQLPNGLQAAYEVSHRDEVRFFKGNKYWAVKGQDVLYGYPKDIHRSFGFPSTVKNIDAAVSEEDTGKTYFFVADKYWRYDEYKRSMDAGYPKMIADDFPGIGDKVDAVFQKDGFFYFFHGTRQYKFDPKTKRILTLQKANSWFNCRKN

SEQ ID NO: 531 - protein, 447 aa, Rattus norvegicus
  Rat MMP-1a
FPVFQDGARQNVETVWKYLENYYNLGEDVQAKNVDAKEVMAEKLRQMQQLFGLKVTGNSNSETLSAMRKPRCGVPDVAPYAITHNNPRWTKTHLTYSILNYTPYLPKEVIENAIERAFKVWSDVTPLTFERVFEEEGDIVFAFYRGDHSDNNPFDGPEYGLAHTFPPGPRLGGDVHYDLDETWTDNSDNFNLFYVTAHELGHSLGLTHSRDVGALMFPSYTWYTEDFVLNQEDINRIQALYGPSPNPIQPTGATTPHPCDGDLTFDAITTFRGEVMFFKGRFYIRVNKFMPEAELNLIGIIWPNLPGKLDAAYEVSMIDQVRYFKGNKVWVVREHTVLRGFPTDIHSFFGFPSSVTHIDAAVCEEETGKTYFFVDNMYWRYDENTQSMDPGYPRLTAEDFPGIDDKVDDVFQKGENFYFFHQSVQRRFSLRIRRVDDSRDSSTWFNC

SEQ ID NO: 532 - protein, 447 aa, Mus musculus
  Mouse MMP-1a
FPVFHNGDRQNVETVWKYLENYYNLGKNMQAKNVNGKEMMAEKLRQMQQLFGLKVTGNSDPETLRAMKKPRCGVPDVAPYAITHNNPRWTKTHLTYSILNYTPYLPKAVVEDAIARAFRVWSDVTPLTFQRVFEEEGDIVLSFHRGDHGDNNPFDGPNYKLAHTFQPGPGLGGDVHYDLDETWTNSSENFNLFYVTAHELGHSLGLTHSSDIGALMFPSYTWYTEDFVLNQDDINRIQDLYGPSPNPIQPTGATTPHPCNGDLTFDAITTFRGEVFFFKGRFYIRVNRFMPEPELNLIGILWPNLPVKLDAAYEASMIDQVRYFKGSKVWAVQEQSVLRGFPRDIHSFFGFPSNVTHIDAAVCEEETGKTYFFVDHMYWRYDENTQSMDPGYPRLTAEDFPGIDDKVDDVFQKGENFYFFHQSVQHRFNLQIRRVDDSRDSSTWFNC

SEQ ID NO: 533 - DNA, 5369 bp, Artificial Sequence
  pET303CTHis vector
gatctcgatcccgcgaaattaatacgactcactataggggaattgtgagcggataacaattcccctctagtaataattttgtttaactttaagaaggaggtctagaatgcatctcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcga

SEQ ID NO: 534 - DNA, 1353 bp, Artificial Sequence
  hMMP-1
  CDS (1)...(1353): Pro MMP-1
  CDS (241)...(726): Catalytic Domain
  CDS (727)...(774): Linker Region
ttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattga

SEQ ID NO: 535 - protein, 9 aa, Artificial Sequence
  fluorescence substrate
  VARIANT 1: Xaa = 7-Methoxycoumarin-4-yl)acetyl
  VARIANT 7: Xaa = 2,4,-Dinitrophenyl)-L-2,3-diaminopropionyll
XKPLGLXAR

SEQ ID NO: 536 - protein, 6 aa, Artificial Sequence
  fluorescence substrate
  VARIANT 1: Xaa = N-carbobenzyloxy
  VARIANT 6: Xaa = 7-Amino-4-Methyl Coumarin
XHRYRX

SEQ ID NO: 537 - protein, 450 aa, Homo sapiens
  allelic variants of MMP-1
  VARIANT 4, 10, 254: Xaa = Pro
  VARIANT 30: Xaa = Met or Ser
  VARIANT 96: Xaa = Arg
  VARIANT 114, 172: Xaa = Val
  VARIANT 166: Xaa = Cys
  VARIANT 181: Xaa = His
  VARIANT 189, 298, 387: Xaa = Thr
  VARIANT 200, 286, 432: Xaa = Ala
  VARIANT 214: Xaa = Glu
  VARIANT 232: Xaa = Asn
  VARIANT 233, 314: Xaa = Gly
  VARIANT 243, 315, 391: Xaa = Ser
  VARIANT 374: Xaa = Met
  VARIANT 386: Xaa = Gln
FPAXLETQEXDVDLVQKYLEKYYNLKNDGXQVEKRRNSGPVVEKLKQMQEFFGLKVTGKPDAETLKVMKQPRCGVPDVAQFVLTEGNPRWEQTHLXYRIENYTPDLPRADVDHXIEKAFQLWSNVTPLTFTKVSEGQADIMISFVRGDHRDNSPFDGPGGNLAHAXQPGPGXGGDAHFDEXERWTNNFXEYNLHRVAAHXLGHSLGLSHSTDIXALMYPSYTFSGDVQLAQXXIDGIQAIYGXSQNPVQPIGPXTPKACDSKLTFDAITTIRGEVMFFKDRFYMRXNPFYPEVELNFXSVFWPQLPNGLEAAYXXADRDEVRFFKGNKYWAVQGQNVLHGYPKDIYSSFGFPRTVKHIDAALSEENTGKTYFFXANKYWRYDEYKXXMDPXYPKMIAHDFPGIGHKVDAVFMKDGFFYFFHGTRQYKFDPKXKRILTLQKANSWFNCRKN

SEQ ID NO: 538 - protein, 11 aa, Artificial Sequence
  Zn binding motif
  VARIANT 3, 4, 6, 7, 9, 10: Xaa = Any Amino Acid
HEXXHXXGXXH

The invention claimed is:

1. A method for treating a collagen-mediated disease or condition of the sub-epidermal extracellular matrix (ECM), comprising sub-epidermally delivering a composition into the sub-epidermal ECM of a subject, wherein:
   sub-epidermal delivery to the ECM is selected from among subcutaneous and intralesional administration;
   the composition comprises a protein comprising an enzyme that consists of the sequence of amino acids set forth in SEQ ID NO: 1, or an enzyme that consists of a sequence of amino acids that exhibits at least 90% sequence identity to the sequence of amino acids set forth in SEQ ID NO:1 and has cathepsin L activity to cleave type I collagen;
   the disease or condition is associated with accumulation of fibrous tissue rich in type I collagen under the epidermis of the skin;
   the disease or condition is treated by degrading the type I collagen component of the ECM in the fibrous tissue under the epidermis of the skin; and
   the pH of the composition is acidic, whereby the enzyme is active in the ECM upon administration, but is inactivated by the higher pH of the ECM whereby it is active for a limited time after administration so that the collagen component in the sub-epidermal ECM is degraded for a limited time to thereby treat the disease or condition.

2. The method of claim 1, wherein delivery is effected by injection.

3. The method of claims 1, wherein the enzyme in the composition is human cathepsin L.

4. The method of claim 1, wherein the enzyme is a single chain form.

5. The method of claim 1, wherein the enzyme is a two chain form.

6. The method of claim 1, wherein the enzyme consists of:
   a heavy chain consisting of the sequence of amino acids set forth as amino acids 1-175 of SEQ ID NO:1 or consisting of a sequence that exhibits at least 90% sequence identity to the sequence of amino acids 1-175 of SEQ ID NO:1; and
   a light chain consisting of the sequence of amino acids set forth as amino acids 179-220 of SEQ ID NO:1 or consisting of a sequence that exhibits at least 90% sequence identity to the sequence of amino acids 179-220 of SEQ ID NO: 1.

7. A method for treating a collagen-mediated disease or condition of the sub-epidermal extracellular matrix (ECM), comprising sub-epidermally delivering into the sub-epidermal ECM of a subject a composition comprising a cathepsin L enzyme, wherein:
  sub-epidermal delivery to the ECM is selected from among subcutaneous and intralesional administration;
  the cathepsin L enzyme comprises the sequence of amino acids set forth in SEQ ID NO:1;
  the disease or condition is associated with accumulation of fibrous tissue rich in type I collagen under the epidermis of the skin;
  the disease or condition is treated by degrading the type I collagen component of the ECM in the fibrous tissue under the epidermis of the skin; and
  the pH of the composition containing the cathepsin L enzyme is acidic, whereby the cathepsin L is active in the ECM upon administration, but is inactivated by the higher pH of the ECM whereby it is active for a limited time after administration so that the collagen component in the sub-epidermal ECM is degraded for a limited time to thereby treat the disease or condition.

8. The method of claim 1, wherein the enzyme consists of the sequence of amino acids set forth in SEQ ID NO:1.

9. The method of claim 1, wherein delivery is effected by subcutaneous administration, intralesional administration or intradermal administration.

10. The method of claim 1, wherein delivery is effected by subcutaneous administration.

11. The method of claim 1, wherein the pH of the composition is within a range of about 3 to 6.5.

12. The method of claim 1, wherein the pH of the composition is within a range of about 4 to 6.

13. The method of claim 1, wherein the pH of the composition is within a range of about 5 to 6.

14. The method of claim 1, wherein the composition comprises a buffer containing an acid selected from among 2-(N-morpholino)ethanesulfonic acid (MES), acetic acid, citric acid, succinic acid, lactic acid, maleic acid, glycine-hydrochloric acid, citric phosphate and histidine.

15. The method of claim 1, wherein the amount of the enzyme in the composition is between about 10 µg and 100 mg.

16. The method of claim 1, wherein the collagen-mediated disease or condition is cellulite.

17. The method of claim 1, wherein the composition comprising the protein is prepared by a method comprising:
  providing a lyophilized preparation containing the protein; and
  adding an acidic buffered solution at the acidic pH to the lyophilized preparation, thereby generating an acidic pH composition containing the protein.

18. The method of claim 1, wherein the enzyme in the composition is a mature enzyme that is generated from a zymogen by activation cleavage to cleave the propeptide, thereby producing the mature enzyme.

19. The method of claim 18, wherein the cleaved propeptide is removed from the composition.

20. The method of claim 18, wherein the zymogen consists of:
  the sequence of amino acids set forth as amino acids 18-333 of SEQ ID NO:62; or
  a sequence of amino acids that exhibits at least 90 % sequence identity to the sequence of amino acids set forth as amino acids 18-333 of SEQ ID NO:62.

21. The method of claim 20, wherein the zymogen consists of the sequence of amino acids set forth as amino acids 18-333 of SEQ ID NO:62.

22. The method of claim 1, wherein the protein consists of an enzyme that consists of the sequence of amino acids set forth in SEQ ID NO:1, or a sequence of amino acids that exhibits at least 90% sequence identity to the sequence of amino acids set forth in SEQ ID NO:1 and has cathepsin L activity to cleave type I collagen.

23. The method of claim 1, wherein the protein consists of an enzyme that consists of the sequence of amino acids set forth in SEQ ID NO:1.

* * * * *